United States Patent 12,059,441 (PROBIOTIC BACTERIAL STRAINS THAT PRODUCE SHORT CHAIN FATTY ACIDS AND COMPOSITIONS COMPRISING SAME) - sequence listing, part 3

SEQ ID NO: 25 - DNA, 4663829 bp, Roseburia intestinalis (residues 1-1,554,610 of 4,663,829)
ccctcaagatgagatatccctcacataagtgagtaagatcccttgaagagtacaaggtagatagggcagaggtggaagcacggtaacgtgtggagctgactgttactaatcgatcgagggcttgaccaaatagcgaacgatgttcgcattggaagttgctttgcaacttcacagttggttgacggagttctgtatgaagttttgaaggtatcagaaataaggcaaaagtcctattgatttttgcataagaaaaaagtaaaataaatgacctatctgatacgtcattttatatataggggattggtcaaatggtatgataggggtctccaaaacctttggtgggagttcgattctctcatcccctgcttggaagaagccttgaacggaagttcaaggcttttttgatatatttacagttttgcatttttacttattttgcctgaaattataaaatctttcttttctggataatatctgattgaaattctcttaaactaagaatataatgtcattatatattcttaaattctaagaaaaatacctatataaattctacttataaagaaagatacatgataacatatatttgccacaatagaaatgaaaaaacaacagaaaaacagccatgttttggaaccgtatgcgagacaagtacatgtcagtgctgtggaggcagggcggacgtgcagtctacgatatactggtgcagacaatgtaatgttccactgtatggtaacagatgcagcagatgcgggatggaggcaaaaaagctgacaacggacgtccggcctgtatttccagaggaaagacttttaatcgaaattatcttgcaaaagccatttgaatttctgaaaaaatcagtctggaatggaacgggaaaccattattttgtggacggaaaaaagattgctttttctgtaaaagaactgaaaaagatcaatgcagatgaagtccgcagacaatatgaaaaatatagtacacagaatacctattgttattttgatgagatgacgggacgctttattgaggcaaataaagaacggtatgagtatatcacgcaggaggcaggaaattatatacgaaaagcagtgggtgagtttggtgcaatggatatgtttgtttcattcagtggaggcaaagattctacagtgacttcgaatctggtattacgtgcattgagcacacctcagatcatgcatattttcggggatacaacgttggagtttccatttacctatacctatgtggaaagatttaagaaaaatcatcctaaaacacctgtgatctctgcacgcaataaggaaaaagattttgaggaactatgcaaactgatcggtccgccgagtcgtgtgatgcgttggtgctgtactgtttttaaaacgggaaccatacagaaaaaaattcgttcgttatacagggacaaaaagcagatattgactttttatgggatccggcgcagtgagtcagtaagcaggagcaagtatgagcgtgagtctgacagtccgaagatcacaaaacagaggatcatatcacccattatcgactggatggattttgacatctggttatatattcttacaacagaaattgattttaacgatgcataccgtcttggctatgcgagggttggatgttggtgctgtccgaacaacagtggctggtctgaatttttatctaaggtacatatgcatgagcagtcaaagcattttagagagatgctgattgattttgcaacaagcattggaaaagaagatgctgaggtttatgtggatgatgggtattggaaggcaagacaggggggaaatggtgttgcgtatgcacagaaatccgttgtgtcattcacaccatgtgccacggaggaaaattcgttcaattatgaattacagcgtccaatttcagaacagttgtatgaactattccgtccattcgggtatctgaattttgatatgggaaatacaaggctgggagaggtttttgtacttgataaaagagagcagatcgttttgaaactgcaggggcggattggaacaaccaatttgagagttaccattttaaaaacagaaatagccggtgcgaaagatttgaaaacagcggaagaaagaataaaatgtcagctcacaaaatatcagatgtgtatgggatgtctggcctgtgagagtgtgtgcagatttaatgcgctttctatcagggaaaataaagatggggagattgagtaccatatttcagacgaaaaatgtaaacgctgtggcgaatgtgtgaaccattttacggctggatgctatatgagaaaggttctggcaatcaaaagacagcggacggaggataaagaataatgggaaaaaataaataccgttttaaagggcatgaaagttttatccttcgtgaaggatggctgaataagggtttatatgaagtagaccgtaatccgaaagttttttcagaaaattatggagcagatgcacttggagtgggaccgaatatggcaaaggcaatccggtactggctcagggcagcagagctggttacagattctccgaaaacgggtgttatgctcactgcgattggtcagttgattcttgcacatgatccatgcgtggaagattattttacattatggctgatacattgcaaaattgcaaaaaaccgggaactggcaacggcatggaatttattttttaatgaagtttcttatgaggaatttaaaaaacagcagctatatgatgagatggagacattactcagtgatttagacgatgaagtgcaggttgcgcagagttctgtctatgcagattgtgatgcaattttacggatgtatatgccggcaaaggagacaaatcccgaagaaaaaaacgccagtccatttggaaagttaggattattgaaaaatacagaggggatttactacagaaaacagccagatctgaacaaattaccggaggatattgtctggtttttattggtagataaggaaaaaaaccgtacgtctgtttatctggatgatctgtggaaagaaatggacagtccaggaaagatactgcagttgaaacgtacagcattgatagagatgttagagcgtctggaggaaaaagataaaatcgtaatgaaccgcactgcaggtcttaatatgatttattgggaaaaaggattgaccggggaaatgatcgtaaaaaattattacgaaagataaagacatataggagttgccggaatggaacaatggagaaacttaatacatatcaaccgtaatttccaaaaagcagtcaatttgcagcttgatataggagatcatggaagaattgaacattatataccgacacggtcatccatgttgatattgcgcagatatttaaaagctgtgacgggagaggcaaaagaacatgcaactgttttaatcggtccgtatggaaagggaaaatcccatttattactggtattgctttcaattctttcctgtgacctgccacagagtgtttttgaaaaaataaagatcacagatccggagacagcggatttagtcacgcagatccggaaggagaataaaaaatatttaccggtattggtttcttctgtaccggggttttccatgaatcagattttattattcgcactgcgcgaggcattagagaaaaatggtttgtcggatattgcaccggagactgcattcacagaagcacttagaatccttgaaaagtgggaaaaggaatattcggatgtgtatgccagattttgtgagtatctgacggaacatcagacagatgtgcaggatttgaaaaagaatctgaaaagaaaacataaacagtcattggaattatttaaagaattatatccgatgctgacggcaggaagcacttttatgccattgatgcagtctgagaccatacggtcatatcagcagattataagaagtctgacagaagaatgtggttatgagggcatctttattatttttgatgaattcagtaaatatatagaaggacatgagaaatccggttttgcagaggatatgaaaacgctgcaggatatgtgcgaattggcggaaagttccgatcagaaattattttttacaatggtggcacataaaagtattcatgagtataccaggagtatagacacttccatgaaaaatgcgtttcgcggagtagaaggaagaatttcagagatatctttcgtcgtatccgcacaaaataattatgaattgatcgccaattcaatccggaaggaagaacctgcgttttcgaaacaatatgaaaaagagattgtgaaaaatgagcaggggaagctccagaagttatcctatcagcttccatgttttcagaaattattttcagagcaggactttgaacggatcgttgccaaaggatgtttcccgctgacaccgcttgctgcgtatgcattacttcatatcagtgaacgtgttgcacagaatgagagaacaatatttacatttttagcagatgatggacagggaagtttatcatggctgttagagcggaatgaagaaaactgggtaggcgttgataaaatttatgattattttaaatcaatgttccgtgaaaccgaagatgtaccgatgatccattcagagtggctgaaggcagagtatgcgctgggaaaagcggaaacggaagatgagaaagctgtcataaaagcaatcgcagtaatccgtatgttacatagagaggatgaacttcctgcacaggatcaggcaatctgtcttgcattagggatggacccggaaaagaagtatcgtcctgcaatggaaaaattaaaaaaagatgggattttaatgttccgcagcagtgtcggagtatatgcattccgcagcaatgcaggcgttgatgtggaaaaagaaatcacgaagaagatggatgagcaaaaagggcactgtaatttttgccagattctgtcagaggctgcagacacagagtatgaactgccaaagcagtataatcaggaatatgcgatgacacgctattttcagtatgagtatatgttttcagaagagttttttgccctggaaaatacaagatatctgtttgatgaaaagttttcagacggaaaaattatagtgatgccggaaaaagaaaaaccccaaacagatgagatacaaaagcagttagataaactggcggataaaagaattcttgtgttagtgtccgaccaacgttttgacaaagaggaattattacttcgctatcaggcggttatgacgttaaaaggggacaaacgctttattgaagaaaatgaagtgctgctgcaggaacttgaattatgtgttgaggatatccggtttgaaattaatatctatctggaagagcattatctgccggagagcggaaaggtaatagttctccagacgcaaaagaaaaaagaaaagtgtacaacggccgcagaatttaatcagatattaagtgatgtctgcagagaatattatggctacgcgccgcgtgtaaaccatgaactgttaaatattgaacacatcggcaagcagtatttaagagcgcgcaatcaggtgatcgataaaatgttagggcatgaggatctgtctgtgtaccaaaaaggaaccatgccggaggctatggtatatcgtgctgcatttgtgcataccagaggggataagggctgtcagaaagttagtttagagatagatcgtttttttgcggaatgtgcaggtgaaaaaaagtcttttcagatattataccagcgattgcagggaaaatgttttggcgcaaggcgaggagtgattccattgtttctggcaaaaaaattatctgaaattgaaggaacagcggtcatttatattggggagaaagagctggaaattacttcggataacctgaatcatgtgaatgattttccagaaaactatgcattgtatctggagctggaaaccgttgaaaaagaaaaatatttaaaaaaattggaaaagatttttgaatgtgatacggagaagttttccggacagagcagattcgcacagattgctgcctgcatgcagaaatggtatcggtcacttccccagtacacgatgataacactaaatcttccggaaaatcaaagtggatcgataaagaaacttaggaatctgttgagaagagcagaaatcaatccaagagaattgttatttgaaaaaattccggcatgctatggagaacctggttttgagcaaacggcacaggatttaaaagaaagtaaaaaaatattagatgatgtatttattacattaaaaaaacaggtcgcaggaaacataaagcgcgaatttggaaaaacgcagaatgtgagtctgaaagcatgtttacacgaatggtatctggcacagaattattcatcaagaaatcatgtactggcaacggcagagagtgaatttttgaattatttagagaaactttctaccaatgatgagggagaaattgtatcagcgttgtcttatattttatcaggggtatatttagaggactggaatgatacaaactttgtagaatttcaggagaaattgcacgcggtaaaagctgaagttgaaaaacttgaggaacatggtaaagatgcaggtggcagcagtcgtatcctgttgacagaccagaatggaaatgccatagaaaagtattataatgcggatatttcggatacaacgagcctttacttaaagaatatgttagaagaggcattggaggactttgggaatacgctcgaaacaaatcagaaggttgcagtgctggtgcagactttagagggattattacagtaagagaagaggagattggttatggaagaaatttatcttgataatgcagcgacgacatttccaaaaccagaatgtgtatatcaggcaatggatgaaattgcgcggaccggtgctgtcaatgcaggcaggggttcttatgcgctggcgcggcaggcatccgggttgattgagagtacaagaaaacagatcaaagaacttgcaggagcagatgatgtagcagaggttgtgtttacagcctctgctacgcttgcatgtaacgtgattttagggggactcgaatggaaacagacggatatcgtatatgtttcaccttttgagcacaatgcaatgatgagagtgttgtatcattaccagaaacaatatggatttaaaattatcgaacttgcattaaacagggagtcgttagaattagatttgtcacagatcaggtttcagttcaccagagaacatccaacagtcattgttatgagtcatgtcagcaatgtgacaggttacattctgccaatcaatgaggtggcagagtcagcaaaacaatatggagcagttgtggcggtggatggttcacaggcgcttgggcttgtgccggtaaaattgaaagagagtggaatcgatttttatgtttttgcggggcataaaacactctatggtccgtttggagttggaggatttatcagtgagggggatatttctttaaaaccgtttcttgtgggtggaacaggcagtgattccttaaaccttgatatgccaggacaaatgccgggaatcttagaaccgggaagccccaatatagttgcgattgcaggattacatgcagccttagaagcgtgctgtgacatggaaaggcaactttcacaagaaagaaaatttgcagaatatctgattgaaaagctaaaaagaatagacggagttttactgtatctgccttgggatgaaatgaaacgaaccggaattgtttctttttccatagagggttaccgtgcggatgaagtggggatgctgctcgatgaagattatcatatagcggtcagaacagggtatcaatgtgtaccgctgatccataaatatttaaaagatgaaaaatatggcggcgtgatccgggtggggatcggacgttttacaaagcagagtgagttggaaatattaatcaatgcgatagaagaaattgcagaagggtgaaggaaaaatggaaaatcaacgtttggattttggagagattgtcagaaaaatcgcagaggataaaatgctgctgccggattttcagagaggatttgtctggaaggatgaagaacagagaaagatcgtagcatcagttctggcaaaaatgccgatagggagtattttactgttgaaatcaaagccggatgagtatgcatcgaagtcaatcggtatgaaagaaaaaaatacatatcaaagccaggatggtgaggtcgaatttctactggatggacagcagcgtatgacagcgcttacgaatgttttttcaaatgtgatttatgaaaaatgtaaaatgttttcaaaattgagttcacgggcattacagcgaagattttttttaagaattccaaagtgggagaactgtaaagaagaggcagatctgtttggagtccataatttgacttttcccatatcagattctgcggaaccggattttctgacagcggatattttaccgtttattacatgtgccgcattttttaatcaggatggagagccgtataatccacagcagtctttgtcgacccgtctggatgatttttgcctgacaaatgaggatggatatttagtaccgctgtatttgatggtggcaccggaaaatataaaaaaggcgcagataatgctgcgctataatacgatcacctctgatattgcaggtaaaatcggagatgagatcagacagcattttacagatttgtcggatgaaaataagaatgattttatagcagagatttttggaaatgatgaaaactgtaatgaaataaaagaagatcattctaagttcggtgaaaaagtgcaagaaaaacaaatggtgtggaaagtctgtctgacaaattatctggattcctgtgtaaagaatatggcgttgaataagattgaggtatcgggggaacagcgtgacagggcgatcgatatctatgagaatttaaatcgtggaggaatcagtttaaatacttttgatctggttatggcgagagttgcaaaagtaagtacagataatttttatcgtcgtctggtcaggtatattcaggaagaaaaaagttatgacaaacaggtcttaccggatcagattgttcccttgattgggaaaaaaatacaaaataatcaatacaatgcatccatcagtacgggatgttataacgaggaaaagaatgacatagcaggaaagtatattgatgtttttttagatgtgctgtgtctgtattgcaataacaagttatttgaaccggataaattcaaattagattatataaagaagaagcagattctgatgttagcaccaacggatattaatgataatgcgaaaaaggtttgtgatgccatagacagggtaatgtttttctttcagagcagatgcggaattcggaatatccaggaaataaattattctttgatgattgtcttagtggcagttatatttttaaaggatgagtggtttaacgataaaactgttcacgatattttagaagcgtggtattggtcatcattattttccggcgagtatgataaagatcagaatataaagatgatcgcgcatcttcagaccatggtaaagacaatgcaggcatccagccgaaaagagaatgttgactggattgcaaatatcaaaaattatgtgttggaagcacagaatttttcggatgaaaagtttttactgatggaaaaggcggatgaagaccgtatcccgaaaaaagtgatgcgcatgtttatgtgtcagtatctgctgtcaaagacatataaggatatgtttgacgaaaataaaattttaagtgcatattccgatgaaacagaaagatttgaggcacatcatattataccgcttggaacagtaaaaaaggtaggggaatctacgaaaaaacttcgtgatgatgaaaaaaatatctgcaactcgcctttaaattttgtgtacataacgaaaaaagcaaataaggaaatatccgatgaatccttaaaagattatgtacagaagatcaacgcggaagcaaaagcaaaactgcatattacggcttatacaaattcggatataccacaagatcaggtaaaacagattttaagggaacggtatgatttcctgaagggggatatcagggagcggatcagtactttattaagttaaatacggcttggaaagtgcagataaagatattgttttacgaaagaacaatgcaggatggaggtattttatgaaagaggtcagtgaaaaagtaatgcggaatatgatttttgaggttcttcatgtggagcgtaaaaatttgcggagcaaggcaaaaacagatcagaggatggctgaggaacttgcaaagatcatagttgattatgcgaagatgtcagtgtagcagacttagggggagaatagcatgaaattccagagcattacaatgaataattttatgaggtataaggggcagaatgtaatcgagttcagctgcgatgaaaaaagaaatgttactgtcgtgctgggagataatacggttggcaagacaacaattgcacaggcatttcgctgggtgctttatggtgcggtattgacagaacgcggaaagcagcaggaagactaccagctgttaaacaatgatattctggcaatgatggatgcgaacagtaaagcggatgttacggtggaactggttgctgttgatgatgaaaaaagataccggatcaagcgtgaaatccattatacgcgtgcatatccacagttgatcgcaaaagaattttataagaaagtttcactggaaatatcagaaaaggatgatccaaatgccggtatttctgtggaaacggaaaaaatagaagaggtaatccgtgaattatttcccaaaaatctgtcacattattttttgtttgatggagagagatggaatgatgtaactgttaacggtgtgcgtgaaaatatcaaagagtctgtacatacactgaccggattatctgcgtatcaggctgcaatctggcatttgaaggatatgggaagtcattccgttattaaaaagttcaaaggaaagatatcaggttctggtaatatgtatgataatctggaaaaagaccggaatcgcatggaacatgagatagagcagtgtaaagataagataaaaaatatcgaaatcaatatacaaaacaataatgaaaaaatagaggaggtgcagcagtatcttcttgaaaataagaatacggaaattttgcaggcaaaatataaccagttattagtagtaagaagaacgcaggcggaaagaggagttgctgcatataaaagtctggtaaatttattcagtgataaagcttatatgttgtttgcgaaaccgatgatagaggcatctgtgaaaatggtaaaatctgttgcaggagagcggcgtgacataccgcatatgcatcaggcaagtattgactatattataaaaacaggcagatgtatctgtggaactccaatattaccggagtctaaggaattagaaagtctgatggaacagagaaattttcttccgccggcagatattggttcattgctgggtgagtttgaacggacaggacagcgctggaaccggcaaagcaattctgtttatgatgatttaagagaagatgcgcaaaatgtggatcagagcatccgggcttacgaggaaacctgtaatcagttagccgggatggaacagcagatggacaggcagacagactttgctgaaaaaagaaaaatgctgaaatattatcagagtgaaaacagtaaattaggggtggaaaagggaacattgcagggacagatcttaaattttgagcggcagatcgaacgaacagaagctgagatgaagagtcaggaagtcagaagcgaagaaaataaaaaatggcgagagcgtgtagatttggcagaagcattatatacaagattaaaaaatgattttgaggtaaaaaagaataagacatttctggaattaaacggacagatccaaaaaaattttgagcgtatgttcaatgcgaaagataaaagaatacagttgacggaaaattatgagattcagatgttatatccgacagatgtgggtttccgcgaagagaagaatctgtcagagggcgaaaagatagcacgcaattttgcatttatcgttacgatcatggaatacagcagaaataaaaaggcagagcagattggagtggagggtgctggagatacactgccgattgttttagacggaccgttctctaaactgggggataaaaatatcagtctgattgcaaaagttttgccggaagtatcagaacaggtaattatttttatgctggacaaggactggaagtacacaggactcgatgaatatgtcggtgcgtcttattatattgaaaaagtagctgacgaggcatatgcgtccatacggaaagtagaatctgatcagtagcggaaggggatacaaaagatggggaattatgaattttttaagaaggagtttgaatttcatggaaagcatgccaggatggcaggtgaattgtgggtaaaaggtgactatgagcatacctgtttccggagactgatcgatctgtatatggtggcagcagtggtgggatttcgcgtagaccgtaaagcaaaggaagatttctcgccgtttgggacaaagagcattttagccgagcaggtcataaatgcaaaagaagaattagattttattatgcagatgatgatcatgctggatgcgaaagaaagcatgccggctgaggaagcagtaaaaaaagcattccggggtgcggagacggaggaagaatttcaggcttatcagtccatgtttcatgattatgtcagaggcggggtagaggaactgtatgagagactgatcattcaaaaagcagaaccggacagtgaattttatgataataaaacagcaaatctgatgtctgtgttagaaagatttggttatggtttacaggatatggaggagtaataattttacatgatttttgaaggaaaaatgtaaaaaaatcaaaaacaggtatttacaatcgtcgaaaacatgggtataatttaagagaattatatcataccaagtgataattaggttattacaataaggtaagaaacctaaaagctctaatcccattcttcggaatgggattatcttttatacagaagtttattcatgacaatgaccggtatgcggatcattgttgaagcgcgcagaataaaacagttgtcccgtttgctggtatgagagagaacggttcagatgagaggagaaggaacatggacgaaaaaatggattatcgtattgggttggatattggtattgcatccgtcggctgggcggtattacagaacaacagtgatgacgagccggttcgtatcgtagaccttggggtaaggatatttgatacagcagaaatcccgaaaacaggtgaatctttggcgggaccaaggagagctgcacgaacgacaagaaggcggcttagaagaagaaaacatcgtttagacagaatcaaatggctctttgagaatcagggcctgataaatattgatgactttctgaaacgatataacatggcagggttaccggatgtttatcagcttcgctatgaggcattagaccggaaactgacggatgaagaattagcacagatgctgcttcatattgcaaaacatcgtggattccgttcaaccagaaaggcggagacggctgcaaaggaaaatggtgcagttttaaaagcgacggatgaaaatcaaaagcggatgcaggaaaagggatatcgtacggtcggggagatgatttatttagatgaagcatttcgaaccggatgttcctggtcagaaaagggatatattctcaccccacgcaataaagcagaaaattatcagcacaccatgttaagggcaatgcttgtggaagaagtcaaagaaattttctccagccagagacgtcttggaaatgaaaaagcgacggaagaattagaagaaaaatatttggaaatcatgacaagtcagagatcttttgatttaggaccaggcatgcagccggatggaaagccaagtccatatgcgatggaaggtttttcggacagagttggaaaatgtacatttcttggagatcagggggagctgcgcggcgcaaagggaacttatacggcagaatattttgtggcactgcagaaaataaatcatacaaaactggttaaccaggatggagagaccagaaactttacagaagaggaacgacgggcactgactttgctgttattcacacagaaggaagtgaagtacgcagcagttcgcaagaagttaggtttgccggaggatattcttttttataatttaaattataaaaaagctgccacgaaagaagaacagcaaaaagaaaatcaaaatacggaaaaagcaaaatttattgggatgccatactaccatgattacaagaaatgtttggaagaacgggtgaaatatctgacagaaaatgaagtcagggatctgtttgatgagattggtatgatcctgacctgttataagaatgatgacagtcgtacggagcggctggctaagctgggacttgtaccgatagagatggaagggttattggcgtatacaccgacgaagtttcagcatctttcgatgaaagcgatgcggaatattatcccgtttttggaaaaaggcatgacttatgataaagcatgtgaggaagccggatatgattttaaggcggattctaaggggattaagcagaagttattaacaggagaaaaggtgaatcagacgatcaatgagattacaaatccggtagtaaagcgttctgtatcacagactgtcaaagtgattaatgcgatcatccgtacatatggaagtccgcaggcaatcaatattgagcttgcaagagaaatgtcaaagacttttgaagaacgccggaaaataaaaggtgatatggaaaaacgccagaagaataacgaagatgtgaaaaagcagattcaggaattgggaaaattatcaccaaccggacaggatattttaaaatatcgcctgtggcaggaacagcagggaatctgtatgtattccggtaagactattccattggaagaactgtttaaaccggggtatgatattgatcatattttgccatacagtattacatttgatgacagttttcggaataaggtacttgtcacttctcaggaaaaccgccaaaagggaaacaggacaccttatgaatacatgggaaatgatgagcagcgttggaatgagtttgaaactcgtgtgaagacgacgatacgggattataaaaaacagcagaaacttttgaaaaaacatttttcagaggaagagcgtagtgaatttaaagagcgtaacttaacggatacaaaatatattacaaccgttatttataatatgatccgtcagaatcttgaaatggcaccgttaaaccgtccggaaaagaaaaaacaggtacgcgcggtaaatggagcaattacggcgtacttaagaaaacgctggggattacctcagaaaaatcgtgagacggatacacatcatgcgatggatgcggttgtcatcgcctgctgtacggatggcatgatccagaaaatatcgcgatatacgaaagtaagagagagatgttactcaaaaggtacagagtttgtggatgcggagacaggagaaatctttcgaccggaagattacagccgggcagaatgggatgagatatttggtgttcatattccaaaaccatgggagacattccgggcagaactggatgtgagaatgggagatgatccgaagggatttttggatacccattctgatgttgccttagaattagattatccagagtatatttatgagaatcttcgtccgatctttgtctcaagaatgccaaatcataaagtgacaggtgctgcacatgcagataccatccgcagtccgagacattttaaggatgaggggatcgtattgactaagacagctttgacagatctgaagcttgacaaacatggtgaaatcgacggctactataatcctcaaagtgaccttttattatacgaggcattgaaaaaacagctgttgttatatggaaatgatgcaaaaaaggcatttgcacaggattttcataaaccgaaagcggacggtacagaaggtccggtagtacggaaagtcaagatacagaaaaaacagacgatgggtgtatttgtggattccggaaatggaattgcagaaaatggcggtatggtcagaatcgatgtgtatcgtgtgaatggaaagtattattttgtaccggtgtatacggcggatgtggtgaagaaggtgctgccggatagggcatcaacagcaaataagccatatagtgagtggcgaactatggaagataaagattttttgttcagcttgtattcgagagatttggtgcatataaagagtaaaaaaggcattccgataaaaaatgtggatggcagcttaggagaatcgaaagaagtatatgcatattatattggagcagatatttctggagcgaaaatagaagggaaagcacatgatagccgatatacttttagaggaattggggtacaaaaattagaattaatagaaaagtgtcaggtagatattttagggcatatatctacagtaaaaaatgaaaaacgaatgggtttttcttgataaaaacatggaggataaatggggtttcgaaatattaagatagacagtcatgtaaaactgtctatcaaaaatcagcagttatatattgaaacagacatactcagacagattccactggaggatatcaactgtatcatcatagaaaatcagacagtaacagtctctgcttatttgctccagaagatggcagatatgggaattacggtctatgtctgtgatgaaaagcatcttccgaatgcagtactgcttccaatggtaaggcacagtcgtcattttaaaattctgaaatatcagatagaggcaggaaaacccttacagaaaagactttggcagcagatcgtggttcgaaagatcagaaaccaggcattgtgtttagcctatcttgatttagacggatcagaagaattaatgaaaatgtgcaaagaagtacagtctggtgatcggacacatgtggaggcgaaagcagcagctttttattttaaaagtctgtatggattgggattttcacggggcaatgatcatgtcattaactcggcattaaattatggttatgccattgtaagaggtctgattgcccgctccattgtctgttatggattggagccttcgattggagtgttccaccatagtgaactgaataattttaatttggctgatgatatgattgaaccatttcgtcccttagttgacctgtatgtatcccagaattatgatgtagcagaaattgacagtgatcttacgccagaaagaaaacgtgatatttttggtattataaattatgatatggatgtgaaaggggaaaaacgcattatcagtaattgtattgatatgctggtggcaagttacagtagtgctctgcagggaaaaagatcagatttggagttgccggaactgatgcaattacaggtacatagctatgaataagtttatgagaatgttagtgttttttgatctgccggtagtaactgcaaaagagaaaaaggatgccgcgaaatttcgtaagtttttgttgaaagatggctacaatatggtgcagtggtctgtatattccaggatatgcaatggtatggatgcagttgcaatgcataaacagcgtttaaaacaaaatctgcctataaaaggatctgtacgtgcgctggttttaacagaaaagcagtatgagtctatggaagtcatgttgggaacaaaaacatttgaggatacccctgaatcgatagaattaatggatgttttttgaaaaaagaagattttcgatagaatttaacttccaaattaaagatttttttttagatgaaatccccacgaatccctgtagttcgtggggatttgtgctccctattataccataccaagtgataacagggaattacaaccaggtctgttttgggctgcgttgtcatataattataccataccaagtgataacagggaattacaacgtgcaatcgtttttaatccattcagtgcgcattataccataccaagtgataacagggaattacaactatatattcattcacactttgccctgctgcattataccataccaagtgataacagggaattacaactttgctcatattgctataagcagggtaataattataccataccaagtgataacagggaattacaacatgacagatatgagcatgggaagtcatgcaattataccataccaagtgataacagggaattacaaccggtcaacaggttttcagttgctttttaaattataccataccaagtgataacagggaattacaacatgaacagatcaagcccggtctgagtgataattataccataccaagtgataacagggaattacaacgcaagttcgacaaagaggcccagctcacggattataccataccaagtgataacagggaattacaacaagaccattaaacactgggttttaaattgtattataccataccaagtgataacagggaattacaacaagctatgttaaagattttaaaagagttagattataccataccaagtgataacagggaattacaacatctgtttacccatgttatgacatttattgattataccataccaagtgataacagggaattacaactggtgggagccttattttcagatgaggcaattataccataccaagtgataacagggaattacaacatggaactgtatctataggaaaatgaaaggattataccataccaagtgataacagggaattacaacgaacgattgaaaatagaagtatgccttttgattataccataccaagtgataacagggaattacaacatcagctcagccttcgcattgacgagctgaattataccataccaagtgataacagggaattacaacacccagatagccctgcaccacacccgcatgattataccataccaagtgataacagggaattacaacaacttgccagtatctattagaaccgttataattataccataccaagtgataacagggaattacaacgccgccacgaaaagcctgtttacacattgattataccataccaagtgataacagggaattacaactccttcgcgtaatggtccgcgcggttcggaattataccataccaagtgataacagggaattacaacgcaagttcgacaaagaggcccagctcacggattataccataccaagtgataacagggaattacaacaagaccattaaacactgggttttaaattgtattataccataccaagtgataacagggaattacaacaagctatgttaaagattttaaaagagttagattataccataccaagtgataacagggaattacaacatctgtttacccatgttatgacatttattgattataccataccaagtgataacagggaattacaactggtgggagccttattttcagatgaggcaattataccataccaagtgataacagggaattacaacatggaactgtatctataggaaaatgaaaggattataccataccaagtgataacagggaattacaacgaacgattgaaaatagaagtatgccttttgattataccataccaagtgataacagggaattacaacatcagctcagccttcgcattgacgagctgaattataccataccaagtgataacagggaattacaacacccagatagccctgcaccacacccgcatgattataccataccaagtgataacagggaattacaacaacttgccagtatctattagaaccgttataattataccataccaagtgataacagggaattacaacacatgtccggcacaagagattatatcgacaattataccataccaagtgataacagggaattacaacgccgccacgaaaagcctgtttacacattgattataccataccaagtgataacagggaattacaactgagggattgagcattgttgaaaatactgattataccataccaagtgataacagggaattacaacaatctaagcacatcagaatataaagcactgattataccataccaagtgataacagggaattacaacggttctgttccggcaaaaatactgtaataattataccataccaagtgataacagggaattacaacctctggtgtgatatgctcgtcctcatggtaattataccataccaagtgataacagggaattacaactctgtatcgccgagattagaaagaacacccattataccataccaagtgataacagggaattacaacatttagccaaatgacaaaatcgctaatgctattataccataccaagtgataacagggaattacaacacccctatccgtgttgcttttggtgatatattataccataccaagtgataacagggaattacaacagtgtggcatactaacgatatagggaattaattataccataccaagtgataacagggaattacaactataaaatgagagaaacgccaaacattaaaattataccataccaagtgataacagggaattacaacggctttattaacaatggctttaaatggcgtattataccataccaagtgataacagggaattacaacaggtgaggtaacagtgccggagaaattaaaattataccataccaagtgataacagggaattacaactaacttttgaaaatgttgaaataaaaaataattataccataccaagtgataacagggaattacaactgatggaaaatattcagagtttcgaacatgattataccataccaagtgataacagggaattacaacttacgatacctgactttaaacttccgcaaaattataccataccaagtgataacagggaattacaactaagcttgcctgcattaccgtccggtataattataccataccaagtgataacagggaattacaacggggtgacaccagatgaaagcatggcatttattataccataccaagtgataacagggaattacaacgtgcctgatgtagaaggcttttgcagttttattataccataccaagtgataacagggaattacaacaaagatccggcagacacggacggagatataattataccataccaagtgataacagggaattacaacattgcctttcggtaaaaaggaacgctcctcattataccataccaagtgataacagggaattacaacaggttcacgacagggaacaaaacgccgttgattataccataccaagtgataacagggaattacaactgaaactggaatgcactcaaaaggctatgattataccataccaagtgataacagggaattacaactagtaggcatgatgtaaactaaggtttttaattataccataccaagtgataacagggaattacaacaaatagatagagcttttcgccctatccctattataccataccaagtgataacagggaattacaacaagtgccgttgataataatgccgaaacagcattataccataccaagtgataacagggaattacaacactacatgacaacatgaccgattatccgagattataccataccaagtgataacagggaattacaacaggagttatcaaaaaaatctttatttacttattataccataccaagtgataacagggaattacaacatggtgcagaaactgagtttacttttagtaattataccataccaagtgataacagggaattacaacagatcatgattcaatttcttataattgcaaattataccataccaagtgataacagggaattacaacatcaatatatgggtttggttggttaattttattataccataccaagtgataacagggaattacaacatatgaaaaattaaaactcacatgcattgattataccataccaagtgataacagggaattacaacagaaaatggaaattatcaaaacaactttaaattataccataccaagtgataacagggaattacaacccggagtttctgtaaatgcaacatcttctcattataccataccaagtgataacagggaattacaacgttacagatatgatgaaagaccttgcagaaattataccataccaagtgataacagggaattacaacgagaagatgggaaatatacaggttatttagattataccataccaagtgataacagggaattacaacaatcacggtatcaagatcacatcctagcgattataccataccaagtgataacagggaattacaacgaggcatctgcgtcaattcatgcactgaatattataccataccaagtgataacagggaattacaacgaggcatctgcgtcaattcatgcactgaatattataccataccaagtgataacagggaattacaacaatcacggtatcaagatcacatcctagcgattataccataccaagtgataatgaggaaaatcagaaaagtatattgaaattacggaaaaaccgtaatcaacctttacactacaacaaaaaaacaggaaaccttgtaaatcaaagtttcctgtttctcaacagaagagcgcgagacgggactcgaacccgcggccccgaccttggcaaggtcgtgctccaccaactgagccactcgcgcatatatgaaattgtattgtagcttttaaagagcgcgagacgggactcgaacccgcggccccgaccttggcaaggtcgtgctccaccaactgagccactcgcgcatatgtaaattgttttgtatctgtctgccagacacatttaatatcatactatggaaaaagtaatttgtcaacaattttttgaaaaaatttaacagaaaaatttaacagaaattttggataccgaaatagaaatgtgagtgcggatctgcggcgaaaaaaaagaaaaacagaatgaaaacgatactttttaggggtagaactcataaatgaagagtgttacaataaaggacatgggaaaatggtcacagaaatttaaaatatgactttgtaaggccaaaggggtggcagaatgtacaaaaaaatgcgaagattcgtactgtagcagttttatgtgcaatattgttaattttaggaatagcattatttggatgttttgggcagatacggggcagtttacagcagcagttgatgagcagcattgaggggatggcagaacagaatgtaatattggtagagaaagaagtaagcacgcgttttagactgctttctggtcttgcgagagagtcaggcggggacgaaaaaattatcgttaataaattacagggatttgtagagacgtatcagtttaaacggataggatatattgcggcagatggtacagcagaaacgacggatggctatcggctaaatatgtctgacagagatttttttcaacagtcgatgcggggaaaaaactttttgacggatgcatttgaagacaggattgatacttcacatgaaaccataaatgtattcagtgtgccggtatatgaaaaagaacggaaaacggtaaaaggagttttatttgcaacctgcaaagatgaaatgcttgaggggtgcctgaagaatgagatatttgaaggacaggcttttaattacatcataaaaatagacggtacgattgttgcaacttccggaaacagtaaagaatggggaattgggagaaatatttttaatacggatgtttctgaggatgaaagagatgattatgccggagacctgatgctcagtaacatgaaagagggaaaaagtggctatggattggatccaaaacggaaagaagtctcactttattactatatgccacttaaaatagaagagagcggtgaaccatggtatgtggtcactgcagtagaggatagcgttttaacaagccgtatgcaggtggtcatggatgcgatcaacagtctgatgatgatcattctggttgtcatatcggtcagcgtcggggtgtatatttactcctggcgccaaagtaaaaaagaacttatgtcgcttgcatatcaggatcctgtcacattaggagataattttgcagcttttaagaaaaaggcaaaaagcaaaaaagatggtgtaggatggctgatcgctatggatgtgacagattttaagctgatcaacagcacctgtggagtcaaaaaaggtgatgaggtgctgcgtgtcatatgggagatttttgaaaccgaaacgggagaaaatgaactggcagcgcatgtcaatgccgaccggtttatattgttctggatggatgaaaatcaggaaaacatcaaacaaagactggaacatgtaataagaaagatagaagagataccggaacgtctggaaataccaaatcttttcccggtgtttggaatttttcatacgatcgtattagatgagatcgatcctttatacggaaatgcagtgcaggcaaagcatcagatcaaaggaaggcgtgacaggcattatatattttatgatgagctgaaccatgagagtattcaggaaaaccgtgaattagaagaacattttgaaacagcgcttgaaaacgaagagtttgaaatctggtatcagccaaaatacagtgcacattcgagaaagcttgtgggagcggaggctcttgtgcgatggcgcagggcggatggagcactgattccgccgcttaagtttattccattgtttgaacggaatggaaatatcatccggctcgatgagtatgtattccgagctgtgtgcaggcagcagaaagagtggcagaaacagggacagaagatgattcctgtttcggtaaacatttcgcgtgtcagcctctattattcaagtgtcgttgaaaaatatgaaagtattatccggtcgtttgaccttgattcgaaatacattcagctggaaattacagaaagtgcaacgattgataataatgaaatatttaatctgttagagcagtttcacacggcaggatttaagatacttctggacgatttcggaagtggatattcatcccttgcaactttaaaccgtatgcattttgatacgatcaagctggataaaagtcttgtcgattacataggggacgataacggagagaaattgttaaattcaattacaaagctggcacagagttttggcatggaaattacggcagagggtgttgagacggtagagcagctgatgtttttgtgcaatctggactgtgatgatattcagggatactatttttcgcgtccactgccggtaaaagaatatgaagaatgtttaaaagaagcgtgcatgtaatatgcttcgcgctcatacaatataacaatcgataccatggaggtacagggtgagcgcaaagacgaggatcgtggtccttcatatgaaggaggttatctatacagcgatatttgtcggacttgggatcgtactggtcatattgctgcttttcatgtttttacctaaaaaacagaagggcgatgcagagccaacgatgcagtatacggcaggcgtatacacttcgtcggtaatgatgggcagccagtcagcagatgtacaggtcattgtagatgaaaaccgtatacaatccatttccctggtcagtctggatgaaacagtggcgacaatgtatccgcttatggagccggcattggaaaatgtcagtgaacaggtgataaaacagcagtcgacggaagggattacatatcgtacggataatcagtatacatcgattgtacttttaaatgcgattgaaaatgcgcttgcgaaagcggagatcgcagagggagaggcagattaacacagtttaaaatcaaagaatgagaggtttgagaactgtgtgttgtcaagaatcaaaaaaggttccggatgtaccggaacctttttgtgtaaaaaagttattcttctgtgctgagcgtatccatgtaattattgatagcgtcaagatcagcatagatcgttttgatcggtctgctcttttcgtaagcgttataaccggagtatcctgcccatccgacgataagtaatgcaattaaccatccacagatggtgcctgcgatacgttttcttttttcttttgcaagaatctttttgcggtttgctttctcttctttatagcggtcaacttttgcctgactcataatcatcctccgttttattattcacatgcccagcatggataaaaatcaaataaacataatgataatataccccattctgttagaaaaagcaatagaaatacaccttgtcattttcgtggaaattgggtaaaatgagagtttgagagagaagaaactgtgcgcgggataagagcatgatgcttgaaaagcagtgcagtgatcagaatggagaatcgtgtgaaaaaaagatctttcacacggctatttgtttctgagcaaaaacaaatagctttgatggcaaggcataaaaaaacatgcctccgagaatttaagattctcgtcgcctcttcgcaataagttgctcagaaatgaggatttttatgaatttaattgtagcggcagatgaaaactgggcgatcggtaataaaaatgaattgctggtgcggattccggcagatcagaagtttttccgtgagacgacgatgggcaaagtggttgtgatgggacgaaagacattggagacatttccaaatggactgcctttaatgggacggacgaatattgtgctgacacatgataaaaagttccgggttccgggagcgctgatcgtgcatgatatggaagaattacatgaagagttagaaaagtataacagcgaagatatttatgtgatcggcggggaatctgtttatcgccagctcatcgatgaatgtgatgtggcgcatgtcacaaaaatcgattttgcatacgatgcggatgcgcatttcccggatctggatgcagatccggcatgggagataacggcagacagtgaggaacagacgtattttgatcttgagtattatttttaccggtatgagagagtcagaaaataagtaaacgtaaacagaaagcagtgcagcaaagatggaaaattttatttacagtatcaatgtgacgtttccgatttttttagtgatggtcatcggctattttttaaaacagatcggtatgttaaacgacaattttgtcacggtggcaaaccgttttaattttaaggtaacactgccgtttatgctgttccgtgatattgcgggcgtggatatcagggcagtattcgatttaaaatatgtattgttttgtgcgcttgtcagtaccgcgtgtttctggctgatctggggtggcgtgaagctgtttttaaaggatcagactatgcggggagcttttgtgcaggcatcgttccgcagcagtgcggcggtgatgggacttgcctttatccagaatatctatggaacctcggcgatggggccgcttatgatcgtcagtgcggtgccgctttataatattttttccgtgatcgtgctgacctttgagggagaaaatgcaagcggggtggatggaaaacaaaaaatcaaagaggcatgtatcggaatcgccaaaaacccgatcattcttggcattttagcaggattgatcgtcggacttttaggaatcgaatttccaacgattatcaataagacggtcaacagtgtggcgcagatggctacaccgcttgcactgatcacgatcggagccggatttgagggcagaaaggcacttgcgaagatcaagccgacgatcgcggcatctctgatcaagttagtgatccagccgctcattttccttccggtcgcagtctggatgggatttggtggggagaaaatgatcgcaattctgatcatgcttgcatccccgacaacgccgagctgttatatcatggcaaagagcatgaacaacgacggtgtgctgacggcgagtgtgatcgtgacgacaacgttattagcggcatttacgctgaccggatggatctttatcttaaaatcagtcgggttgattggataaataaaatcattgcatttcccggtgagatgggatatagttttttgaaagaaaaaataccttggtttttgggaggacgatatggatataacaggcagaaaattatttgtaaaagcgctgcaggaagagggcgtggataccattttcggttatccgggcggtactgtgacggatcttttcgatgaattatataaacaggatagtattgacgtcgtcctgccaagacatgaacagggactgatccatgcggcggaaggatacgcgaaatctaccggaaaagtcggcgtgtgcttagtgacgagtgggccgggtgcgaccaatatcattacaggtcttgcggatgcgcattatgacagtattccactggtatgctttacgggacaggttccactgtctttaataggaaatgatgcattccaggaagtagatattgtcggaatgacaagaagtgtcacaaaatacggtgtgaccgtgcgcagacgggaagatttgggacgtatcatcaagatggcattttatatcgcatccaccggcaagccgggaccggtactgatcgatattccgaaggatatccagacggcagcaggaccggcggagtatccgtcgaacatccagatccgcggttataagccgaatgagtcggtacatatcggacagttgaaaaaagcgtataaactgctccgcaccgcaaagaaaccgctgatccttgccggaggaggtatcaatatcgcacatgcgaatgacaaactgctcgcattggcggagaagatgcagatcccggtggtcacaacgatcatggggaaaggtgcgatcccgacgagtcatccgctctatgtaggaaacagcggtatgcatggaaaatacgcagcaaatatggcagtcagcaaatgtgatgtgcttttttctatcggaacaagatttaacgaccgtattacaggagatctgaatgaatttgcaccgaaggcgaagatcgtacatatcgatgtggatacggcatcaatctccagaaatgtcgttgtggatgttccggttgtatcggatgcgaatctggcattagaaaagctgcttgaatgggcggaatcgaaagataccgagcagtggcagaaggaaatcgcagagtgggataagaaaaatccgcttgagatgcgcagggactgtggcatgacaccgcagatggtatttgagcatgtaaaccgtacctttagagaggctgtctatgtgacggacgtaggacagcatcagatgtgggcaacacagtacctggagttggattcctggcatcagctgatcacatccggcggacttggcacgatgggatttggatttccggcggcgatcggggcaaagatcggcaaccgggataaggaagttgtatgttttacgggagatggcggttttcagatgaatattcaggagatggcaacggcagtcgtgcaggaagcgccggtgatcatctgcctgttcaacaactattaccttggcatggtgcgtcagatgcagcagttattttatggaaaacgttatgaggcaacctgcctgcgcagaaggagaacctgtccggcgaactgcaagggaccgaatgcatcctgtccgccgtacacaccggattttatcgcattggcaaagagctacggcgcacacgggatccgtgtggaaaaagaggaggacatccaggcggcacttgatgaggcgcgtacctacacagatgccccgaccatcattgaatttatgatttccacagatgagatcgtacttcctatggtaaagagcggaaatccaatgagcgagatgattttgaaataggagaggatacggatatgaaaaatagatggattgcattatatgtggaaaaccaggtaggtgttttagcaaaagtatccggtcttttttccggaaaatcttacaatctccagagtcttacggttggtacgacagaggatgagacggtttcaagaatgacgatctgtgtgaccagtgacgatatcacatttgagcagatcaaaaaacagttgaacagcatggttgaggttattaaggtcattgacctcacggatgtgccgattcacatgaaagagattttatttgcgaaagtgttagatgtcgatgaggctggaaaacttgaggtattccagatcgcacaggtatttaatgtgcaggtggcagatatcggaaacgacagtgtactcttagagtgcaaactgacagaacgacgcaacaatgaactgatcgctctgttaaaatccaaattccaccggatcgaggttgtgcgcggtggtgcagtggcgattgagtcaatcagtacgtcatgcaggtaagcatgccggctgtcataacggcagataataaaaaacgggtttgtgaaaatagttttccatagagaaagaggcaggtgataattttcacctgtctccttctttttggaaaaaatttatggaattttattatacgcgcttatttaagaaagcgataaacttttcaaaatgcatcggtgttccctgaatttcctgtactttcaagcggtttttctcgttaaatcctacaagaatatcatggtttgcctccgagaggtaatcgatgataccgtcgatgtcggatttaatattcttcgggcactggatatacagatgcttgttggcactgatatgcagtgtgtaggagatactgaaatggtaccagaaaaacttgtgcagcgtggagtatttgtagatccatatgatctcatcgatcggtacgatcgcattgccgtagacggaagtttcaatgaaaaaatgttccgtgataaacatatcttccgttgcgagctgcggcagtgtggcgagttcttcctccgcctgctctaacatctttttcggattaccaaacagtgcaagatcctggcatgcaggggagagcaccgggaaaaacatgtatatgacagagagcacgatgcagagcaatgcgtaaattccggtaatgaaaattgctgcaaacaggatccagtttccaacgtggttaaatcctggttcgctgatatagtaggaagaaaccttgttgcggataccgttttccgtccagtttaaatcggtggacagattggaaagcagggtgtcgaaattttcatttccctttgaaatctttcctttgatggtgacttcttcgatggaaggcagaccctcctcactggtatttggcgataacaatacgatgatacattcctcgtcacgcatagtgtaataataataaccgttggtgtgaccgaagatggactgggtatatccggtaaattttaaatcggaaagtgtggtgcttatatactgtttaccaccccggaaagcggtctctaacgaggtgtcgtcgggcaaaatgtccggagaaaatacagcggacagcgaaaaaaagtgccatgcaagcatgagcacgatcaggtaaatgatcggagctgcaagtctgcgtttataaaatgccttgatatttttgctgatgtagtgatcgtaattttcgggcatatcaaaatccttttctcaaataaaaaatgacatactgctaatagtatagattcttttttgctttatttcaactaaaacctgtgataagatggtacttgccagtaacagcgataaaaggagattataatttggaagcatatacaagttttgcgcaggtatatgatctgttcatggataatgttccctatgaagagtggagcaggtatattataggacttatgaaagaatatgggatctgtgacggaacagtacttgatttaggctgtggaacgggaaagattacaagattgttgaaaaaagcgggctacgatatgatcggtgtggataattcaccggaaatgttggagatcgcggcggagaccggatatcaggagatgccggaggatgagatcttatatctgttacaggatatgagagaacttgaactgtacggaagcgtgcgtgcagtcgtgagcatctgtgattcgatgaactatctgctggaagagacagatcttttgtccctgttttaccgtgtcaacgaatatttagatccggatggtatttttatcttcgatctgaacacagtatataaatacagagaactcttaggcgagacgacaatcgctgagaaccgcgaggagggaagcttcatctgggataactatttcgatgaggaagaacagatcaatgaatacgatctgacgctttttatccgggaggaagaaggactttaccgcagatttgaggagacgcactaccagcgtgcctacgaattagaaaccgtaaaacaccttttagaacaggctggacttgaattcgtcgcagcatatgacgcatttacgagagagccggtaaaagaggacagcgagcgcatttatgtgatcgcgaggagcaatcaggaaacctgaatgcactatttgctcccaacatcattggagtcatcagaaatttatgagtacagtacgaaatggaggataaaatatgagtgattatattgtaagagcaacagcggcggacagccagattcgtgcatttgccatcacatcaaaggaaatggttgaggaggcaagaagagcccacgacacaagaccggtcatcacggcagcgttgggacgtcttttgagcggtgcggcaatgatgggaacaatgatgaaaggggataatgatcttttgacgatccagatccagtgcggcggtccggcaaaaggacttaccgtgacagcggattcccatggccatgtcaagggatttcctatggaatcccaggtggaactgccgttaaatgcacagggtaaattagatgtgggcagagcgcttggacttggcgtgatgagtgtcatcaaagacatggggttaaaagaaccgtatgtgggacagatcgcactgcagaccggagagatcgctgaggatttgacctattattttgcaacatctgaacagatcccgtccgcagtagggcttggggttttagtggacaaagacttatcggtgcgccaggcgggtggttttatcatccagctgatgccgtttaccagtgatgaggtcattgaaaaactggaaaataagatcagggagatcgcatctgtaacggaaatgttagagcagggtatgacaccggagcagattttagaggaaatcttaggagatttcggtcttgagatctcagataagatcccggctgcatttgagtgtgactgttcaaaggagagagtttcacgtgcaatttctacgctgagcaaaaaagatttagattcgatcatcaatgacggagaggcaatcgaggtaaaatgccagttctgtaacaaggcataccattttgatgtggacgaattaaaggaaatgcgttctgcaaaataaaaaagtgctgctgttccgtaaaaacagtacaagcggacagcagccaaaaggcaaggcaatgtggttgcggtaagcagatgtaaaacgtaaccggaaaagaggaaagaatgagacagggatttgtgaaagttgcagcggtaacgccaaagatcagggttgccgacaccagatacaatgcaaaagtgatctgcctggcaatcaaagaggcagcagaggcgggagcaaaagtgatcgttctgccggaattatgcattacgggttatacctgtggggatctgtttttacaggaaaagctgcttcgggaggcgaaagaagaattattgcatatcgcggcatttacgacagatgtggatgcaatcgtatttgtcggacttccacttgcatacaaaggaaaattatataacgtggcagcggcattaaatcgtggaaaaattcttggtatcgtaccgaaaacctaccttccgaattataatgaattttatgaagcgcgccattttacgagaggtatggaagaagtggccgatgtacggctgaccgaagaattgacggtgccgatgggaacgagacagttatttacctgtctggagctgccggaacttgtgatcgcagcagaactctgtgaggatctctggacgatgaatccgccgagcatcggacatgccatgcacggagcaacgctgatcgtaaatctttccgcatcggacgagacgaccggaaaaccggcttaccgcagggaactggtaaaaggacagtcggcaagactgctctgcggctatatctatgcgagtgcaggggacggcgagtccacacaggatgtggtctattccgggcataacctgatcgcagaaaatggacgtttgttagcggagtcagaactttttgacgcacagacgatatccaccgagatcgatgtgtcccgtcttgcgtccgagcgccgcagaatgacaacatttgagacggtcacagagccggtatatcgtgaaaatgtattttccttacagatggaagagacaaagctgacacgttatattgatccgatgccgtttgtgccgtccggagagcgcgaccgtacactgcgctgcgaggagatcttatcgatccagtcgatgggactgaaaaaacgcttagagcatacacactgtaagtctgcagtgatcggaatttccggtgggctcgattccacgctggcacttcttgtcaccgtgcgtgcttttgatgcgctcggaatggatcacagtaatatcaaggcagtgaccatgccgggatttggtacgacagaccgcacttacgataatgcagtatcattgatccgctgtctgggagctgattttatcgaggtggatatcaaagatgccgtcaacattcatttccgggatatcggacaggatccgtcgatgcatgacgtgacctacgagaacggacaggcgagagagcgcacgcagattttgatggatattgcaaataagtccggcggaatggtcatcggaaccggagatttgtcggagcttgcacttggctgggcgacttacaacggagatcacatgtctatgtatgcagtcaatgcatcggtgccaaagacactggtgcgccatctggtgcgttattatgcggatacctgtggggatgagactttaaaacaggtgctgcttgatgtgcttgacacacctgtctccccggaacttttaccgccggaagacggaaaaatttcacagaaaacggaggacttagtcggcccttacgagctgcacgatttttatctgtatcatatgctgcgtctttcctacgcaccggcaaaggtttaccgtctggcaaaacaggcatttgccggaacttatgacgatgcaacgatttttaagtggctggagacattttaccgccgtttctttgcgcagcagtttaaacgttcctgcctgccggacggaccaaaagtcggaagtgttgctgtatctccgcgtggggatctgcgtatgccgtccgatgcgtgtgcctcaatatggttagcggaactggaggagttaaaggatgcagtatcgcagggataaaaaaggaaatgaattgtctgttttaggatatggatgtatgcgttttactaaaaacggcagcagtgtcgatcttgataaggcggaaaaagaggtgatggcggcgatcaaagcaggtgttaattactttgacactgcctatgtctatgcaggcaatgaggcagcagtcggagagatcttagaccgcaaccactgcagggagcagatctatctggcgacaaagctgccacattatctgatcaagtctgtcgcaggtgcggaaaagatgtttcaggaggaattgcgcagattaaaaaccgattatatcgattattatctgatgcatatgctcaccgatataccgacctgggaaaaattaaaaaagatcggcatgcaggactggatcgaggaaaaattagcgtccggtcagatcagaaatatcggattttcctatcatggaaataccgagatgttcaaacagctcgtggatgcctgcgactgggatttctgccagatccagtacaactatatggatgaatactcacaggcaggcgtggaaggactgcgctatgcaaatgcaaaaggacttccggtcatcatcatggagcctcttcgcggaggcagactggtaaatcttttaccggagtcagcaaaaaaattgttccgcgctgacaaggaaggacgtacaccggcggagcttgccttaaaatggctctataaccagccagaagtaacctgtgtgctctccgggatgaattccatggaaatggtggagcagaacctaaagacggcatctgagtcccatgtgggctgtctgacggcatcagacgcagcactgatcgaacaggtgaaagaagagatcaaaaagcatgtcaaagtcggctgtaccggatgtgggtattgtatgccgtgtccgaggggagtggatattccgggaacattccgctgttataatgcgatgtattcggaagggaaaaaatcaggacggaaagattatttacagtgtacggcattccggaaagacaccgcaagcgcatcccagtgtgtcggctgcggaaaatgcgaaaaacactgcccgcagcatattgagatacgcaaagagttaaaatgtgcagcgtcagaattggaagacgtgaagtataaggtaatgaagtctgcaattcagattttaaaattatggtaagacaataagaaaaggattagagaacatattggaaaagaaaagttttgttttaaagggaaatatcgtatattcaggagaaaacaaggaactgtgcagtatagagggtggttatgttgtatgtgaaaacggtatctgccgcggcgcatttgaaaagttgccgaaacagtatgaaacactgccgctgaccgattatggtgataagatcatccttccgggaatgacggatctgcatgtgcatgcaccacagtatacgttccgggcacttggcatggatcttgaacttttagactggctgaatgtgcatacttttccggaagaggcaaaatatgtggatatctcctatgcaaaaagagcatatggaagttttgtgtctgatttaaagcacagtctgacaacgcgtgcctgcatttttgcgacacttcacagagaggcaaccgttgctttgatggatcttttggaggagagcgggatcgtaagctatgttggcaaggtaaatatggaccgtaacggtggtgagaatctctgtgaggcggatgcgtctgctgcggcagaagatacgaaaaagtggattgaggagacagccggaaaatatgagcgtacaaacccgatcttaacaccgcgttttattccaagctgtacggatgagctgatgagagaacttgcaaaactgcagaaaacgacaggactccgcgtgcagtcgcatctgtcggaaaacccatcggaagtcgcatgggtaaaagagcttgtcccggcagcgaaaaattatgcagatgcctacgctgtttttgatatgttcggagataaggatcacccggcagtcatggcacactgtatttacagtgaggatgagatggatcttttgaaagaacacggtgtctatgtggcacactgcccggaatcgaacttaaatctttcctccggcattgcaccggtccgaaagttcttagaggaaggtattgcggtcggacttggttccgacgtggcgggcggatcttcactttccatggcaaaagctttgacattagcggtacaggtatcaaaaatgtactggcgtctgattgatgagaaaagtaagccgctgacatttgcggaagcgttttatttagcgacagccggaggcggcagttattttggtaaagtcggcacatttttagatggatatgaatttgatgcggttgtcgccgaagatcatattgcaaaggatgtaagggagtatacaccgatccagcggacagagcgcatgatgtatgatgagagtacaatgacgatctgtgcaaaatatgcagccggatgtgcgtgtgagctgtaaaggttcagatagagtgaaaatcagaaaaatttagaggctctccaaatttgaatgaaaaagagtcataaccggcaaaatcggttatgactctttttaaaacgaatcaaatattcaggaaacataacgtttgtatttagatctggtgaagtttgcgctcatatttgcgctcaccggccgtcatgcgtgccggattctgtacatagacaagcatgtacatgaagactgccataatgattccggtaaccacatcaaatacggagtgctgttttaaaaacatggtagataaaataatgcttaccataagaacagcagaaccaatacggatgacctttttatcgcggaaattttcactgtgccatacggctaaattgactgcaatggaattgtaaacgtgaatacttgggaaaaggttcgtcgcagtgtccgttgcgtagaggcattttaccatatgtacaaacacgttatcccgcgcaaaagtagtcggccttaaataatgtccgtttggataaatggtggagatgactaaaaagatcgtcattccggtaaacaacatggtacataaacggaaatattcgtctttatttttaaagtagaagtaaccaagtccccacgcaacatatccaaaccataaaaagtatggaataataaaatattcacaaaatggaatataatcatcgagtgcaacatggatcacatgaaaatgcgtggtaacggttctctctaaatgaccaaaccatggcagataaatcatgaaataaagcagaagaagagcatgtttgtttctctcaataaatgcgttgaccgcatcgcgtgtcttcgttttcacggtttcaccctcttttcattaatctcaacgatagggattatagcacagcatttttttagaaacaattcccttttccttattttaagaaagattatttaaaatttaagaaaactttaagctatgacgggtgtttttggggagtttgacggtaatttttattacagatcaatgcgaaaaaagaacgaattcttaattaaatgttacgatttggacaatttgttgacaagaccttgccggatattataatagagtaggtgtccgttagcatattttatgcaatacaacatatctttacacataggatgaaaggatatttagaaaaatgaaagagaaaaacaagcggaaaatgcatggaggtgcgtcagcaaaaaattatacaggactggtgctcacatgtgttatgacggcgattgctgtgatttatgtcgggtttgcgatttattttgaaagtcatttttgttttggaacttctattgatgggattgcagtcggtggcagcaatgtggaaaaagtcgaggatgcgatccggactgagatgaaaaattacaatctgacagttactgcacgcgaggataaaaatggaaccattgcaggttcggatattgatatggagccggtatttcagggggaaatagagaaacttttagaggagcagaatggttttgcgtggctgatcctgatgttccagaagcaggagtttgaactggcaaaggttgtatcttatgatgaacagaaactggatgaggcagtcagaaatttaccatgtatgaaagatcagcgcacaccggtggatgcgacttattctgattatacaagagaaaacgggtatgcgcttgtaccggctgattatggaacacaggtcgataacgcaaaagtcaggaaagcggtaagtgatgcggttttagtattggatgaaaccgttgatctggagcagagcggctgttatttagagcctgcaatcggagatgatgataaagatctgctggctttgatcgatgcattaaaccagtatgtcggtgttacgattacatatgactttggggatgataaggaaatattggatggaacaacgatcagtacctggctttctgagggaaccgacgaaaaagtttccattgatgaggaagaagtccttgcctttgtaaagacactggcaaagaaatataatactgcctattcaccgaaagagttaaagacttcctacggtacgacggttacgatcaccggtggtttttatggctggagaatcgataacggaggggaagtagaacagattctggcagacttaaaagccggaaaagatgtggagagagagccggtatatctcacaacggcaaacagtcatggcgagcatgattacggtgattcttatgttgagatcaatctgacaaaccagcatttattcctttacaaagacggaaaactggtggtggagagtgattttgtttcaggaaatctttcaaaagggcatgacaccccgacaggtgcgttcggactgacttataagaccatgaatgcggttttaagaggaccggattatgagacaccggttacttactggatgccatttaatggtgacgtaggtatgcatgatgcgacctggcgtaacaaatttggaggaagtatctataagaccagtgggtctcatggatgtatcaatctgcctgcatctgcagcaaagaagatctatgagacgatcgataagggatatgcagttttagtatatcgtatgccgggtgacaatccgactgttgtgcagcagccgcaggcggatgttccatctgtgatcaatgcgatcagtattatcgggcctgtaacattagagagcgaaacagcaatcgtgaatgcgagaaatatgtacaactcactttcagatgcagacaaggctcaggtaacaaattatgacacactgacagcggcagaggcagcacttgcggtattgaaggcacagcagccggctgatggagggcagcagccagatcagagccagccacaggatcagagccagcagccagaccagagccagccacaggatcagagccagcagccagaccagagccagccacaggatcagagccagcagccagaccagagccagctacaggatcagagccagcagacggacggaagccagcaggatcaaagccagcagacggacggaagtcagccacagggatgatgaaaacaatttaacagatacaggtcaaagcaaaaaaagctcctgcgcattaaccaagcgcaggagctttttgctgccaatggattgataaacgatcaataacgttttatggaaggtttaggagctgctgtagtattcgttccggaagaatgctgctttggaagtgaaacttcttttgctgcagtattgtgggcagatacagaacctttgcgtggtacgctgcagcctaacagaacgctgactgcttcatgcatttccggatgcgcacgataggcttcaatgatcgtccgctcagaaggtgtcacatgaaaattctcattgctgtcatagccgaatgcttcaaggatatctgtgatattatatagatcgcagagtgttaaaaggatatctgcgcttggatttgcctgtccgctttcccatccgtaaatcgttttgggagcggcggtaaaagaacgatcctctaacaggatagaaacatcatttacagacaggtgattccgtttacgatattcttttaaaacttttgctatattctgattccgcatattgatctccgttctgttgcatttaaagcagccaaaatgctttttaatcgtatcatatcccacctcattttatcagtcaatgagttcttaattgtagagaaaaatataattgcaattcctaaagttaaagaatagaataagaaaaaacagatttttgtagaagaggtgcgataacatgggaaaatcaaaagtgacggattatatgatccggtatattgaagaaaaccggatggatgcaaaatcgctggcggcacatgcgggcatcgatgcaggaaaattgcggaaggattataaggaaccgctggatgcggaggaatttctttcactctgcgcatatcttggtatcagaccggaacaggtacagcggatgctgtgaaccactatttgcctccgacataattacgtgcaatgcgtaaacagcatcagggtataaatatcggtaagatgtacatactgatcacatagagaacatgatataaaaatgtttggaaatggagattcgtatgagcatgcagacgggaaaacagagtatttgttttgaaacgccgccttatattgtaagcagcgcaagtattgtcgggaaaaaagagggggagggacctcttggagcctgttttgatctgattggggaggatgataaattcgggcaggacacctgggaagaggcagagagtaccctgcagaaagaggctttcggaatggcagtcggaaaagcaggactgaaaaaagaagagatacgttatcttttttccggagatcttttaggacagaatattgccacttcgtttggactcatggattaccaggtgccgctctttggcctgtatggtgcgtgcagtacctgcggcgaggcgctttcccttggagcaatgtgtgttgccgcaggatatgcagattacgttgtggcgatgacatcgagccattttgccagcgccgaaaagcagttccggtttccacttgaatatgcgaaccagaggccgatgtctgcaacctggacggtgaccggaagtggtgcgtatgtgcttggaaaaagaaagagcaatgcgtgtattaccggtatcacgaccggaaagatcatcgattacggcattaaggattccatgaatatgggagcagcaatggcacctgcggcggcggatacgatctgccagaacttaaaagatttcgggcgcaggccagaggactatgatcacattattaccggggatctaggcagtgttggaagggagatcctgatcgatcttttgaaaaaagaaggatacgatatcagtgagatgcatttagactgcggtatgctgatctatgagagcaaagcgcagggaaccggggcaggaggttccggatgcgggtgttctgccgtaacacttgccggacattttttaaaacaggtcgagcagggaaaattacagcgtattctgtttgtgccgaccggggcacttctttccacggtgtcttttaatgaaggaaaaacggtgccagggattgcacatggagtcgtgatcgaacatgcagattaaaagagagaaagaggtgtagaattatggattatatcaatgcattctgggttggaggggcaatctgtgcactggtgcagatcttaatggaaaaaacaaagatgcttcccggaaggatcatggtgatgttagtgtgtcttggcgcactgctcggggcacttgggatctaccagccgtttattgaatttgcgggagccggggcaagtgtgccgctgcctggatttggaaataccctgtttaagggagtgaaagaagcggtggacgagtatggatttttaggaatttttttaggtggattaaaagcaagtgccgctggtatttcagcggcactgatcttcgcatatctggcaagtattatttttcagcctaagatgaagaaatagatattataaatattttttgatctcttcgatcaatgcggcatattcctcatcggaaagaaatttttcgcccggattcatggcaaaagtgccgccccactcgtaaccgtctgtatattttggaacgagatggaagtggagatgatggccggtatcaccgtaagcaccgtagttgactttctgcggatgaaatgccttgtgaagtgcttctgccacatgattaatatcttcaatgtaagcggcgcgttcctcagcggtcagttcagtgatctcactgacatgttttttgtgagcgacgatcacacggcctttgtggctctgctccttgaaaagataaacttttgaacttggcagttcacagattttaataccaaactgggcgactaattcgtcctccatacaatatgcacaattctgatccataagaaacctcccgtgtctgtttttttattatttaatattgaaaaaaaggtctgcacaaatcatcgaccggtgcagacctgatttttttaaattatttctggttgaagtgaacagcgaaacctgcgatctcgtcttttaagtaagcaacagtaagctcacctttgtcattgtatttgaaagaagattcgtcaaatacaaaaccacgtttttcaagatgataaatcgcgcggtctaagtagttggtctgaatgcagatatgaccattggttccgcgtcccggattcttcatcatttcaattaaagaacctacgaacatggagctgtttccaacttttacattctcgccaagtaaggtggcgaattttgcagactctgcagcagctacttcctcagaagcgttgttaacacctacatgtaacagtttgaatcctaacatggtagaaacagcctcttttgttaaagctgtaatgccatcccagtcttttgcagcgatcatgtctttgtttaccatccaggaaccaccgcatgcgatgatctttttgaaatcaaggtagcttgttaagttctttgcgttgataccgccggtcggcatgaatttcatctttgtgtaaggagctgccatggatttgatcatggaaagtccgcctgcagcttctgccgggaagaatttcacaacgtcaagaccaagctcgattgcaacttctacgtcgcttgggttagagcatccaggagttaccgggattcctttttcaacacagtattttacaacttttggatttaaaccagggcttacgatgaattttgcacctgcgtttacagcgcggtcaacctgctctgtggtaagaacagtacctgcacctactaacatctccgggaactgctcggacatgatgcggatagattcctcagcagctgctgtacggaaagtaacttctgcacatgggagaccaccgtcgcataatgcttttgctaaaggtgcagcatcctctacattgtcaagtgcgataaccgggataataccgattttggaaaactcttctaatactttgttcataattcttctcctttattttgaataattttaaggttcttaaattggtttcacaatatgaaacattgtttcatacaacggtacaatagtattataacattacaaaatgccttgtcaataatttagggaaagaaaatgttgtattttgcaaaaaacaaaaatttgacttttattggaatgtcatgttatgatgtcatatggtttcatataatgaaacaataatgtgaattatgaaacctaaaagacaggtattggaaaaataactgataccttacatagaatatgaggtaattatggcagaacagaaagaaacaaaaaatccggtgcagtcggcagagcgcatttttcaggtaatggaaatgctggccgatcacggtgagatgggactgatggagatcagcacagcgttaggacttcacaaaagcacggtacatcgccttctgatgtctttagtctatatgggatatgcaaaacaggacgaggtatcccagaagtatatgctttcttataaaatagtcagcatggcaggaaaaatgcttgaccgcatggatattttacaggttgcaaaaccttatatggagcgtttgtctgatatcagcggggaaacagtgcatttagttcagcgggaaggaaacaatattttatatatttataaaatagaagcaaaaatcggtacgatccgcatggtgtcccatgtggggatggtccatccgatgtattgttccggtgtgggcaaggcaatcatggcagaacttccggagtcggaagtgaaacagatctggaatgagagcatcatcgaaaaaaagacggagcatacgatcacggattatgatgatatgcttagtgtattaaaagaagcaaaaaagaacggttatgcacttgatgatgaggaaaatgaagaaggtgtacggtgtattgctgcaagcctcagggattatcataatgaagtaaaatatgcattcagtatttccggaccgaccagccggatgacgcgagaacgggtggaggagttatctgtggatgtcagaaaagtacaggaagaattatccatggaattaggctggtatagaaaatagcagacatggtcatactatccttgaaaaggtgatggttcagagagcttttgaaccgttacaaataatttcttgtaaagtaaaggagaagaatgaccatgaaaaagtttaaaatgcttgcggcatgtctggtgcttacattgtctcttagcgcactgaccgcatgcggcacaaacagaaacaacacaaataccaataacagtggcaacaatccggcagccggtacagaaaaccgtgtcaatgaaaacacaaataacggtatcaataataccgaaaatggtatgaatgataccaatgtgaatggaacaaatggtaccgtgaatgacacggatacgaacggcacaaatacaaataacacaaacgcgaatggtgcagacacagacggtggtgctgttgtggatgatgtggtggatggcgtcggcgatgctggcaaagacattattgacggcgtggaaaacggcgtggatgacgcgaccggaaacaataataacggtaacacaacggataacagtgcaagataacggatgagaaatttccgggtatggcctttttgtgaaagggctgcccggattttttgtgtcaaaaatccttaaataaaaatgaaatctttctgattttcttgtgattgcagatgttttgcggtacaatgtcttaaataagtctgctttgggcagagatatggaaaaattcaggagcgtattcagatgaataataatgattatagagaaataactgaggatgatgtaacaaccgtatccacagatcagaaagaggaaatgaacggacaggaaagcgtcaatgatacccctgacgtgtcagaaaatgaaaaggagaccgtgcaggcggaagtgacaaattcagacgcatcgaatgaaaaagagccggagtatgaggatatctgctatatctgccgcagaccggagcatattgcaggaaagatgataaagatcccgaacaacatctgtatctgtcaggactgtatgcagaaaacgtttgacagtatgaatcagaccggattttcaatggatgatatgctgaacatgaatataggaaaaatgccgaatatcagcatgatcaatctctcagatctgcaggggatgcagggatttattccgaataaccagaaaatcaaaaagaaaaagccgaaagaaaagaaagagccggtacttgatatcaaaaagatcccggcaccacataaaatcaaggcatcgttggatgagtacgtagtgggacaggagcatgcaaagaaagtcatgtccgtcgctgtttataatcactataagaggatcgcatccgatgagaaggacggcatcgagattgaaaagtccaatatgttaatgattggaccgaccggttccggtaagacttatctggtaaagacacttgcaaagcttttagatgtgccgcttgccatcacagatgcgacgtccctgacagaggcagggtatatcggtgatgacatcgagagtgttgtcagcaaactgcttgcagcagcggacaatgatgttgagcgcgcggaacacggtattatctttattgatgagatcgacaaaatcgcaaagaaacgcaacaccaatcagcgtgatgtcagcggagagtccgtgcagcagggaatgttaaaactgttagagggtgcggaggtagaagtgcctgtcggagccagcagcaagaatgccatggtacccatgacaatggtcaacaccaaaaatattctgtttatctgtggaggcgcgttcccggagttagaggatatcattaaggaacgcctcaataaatccgcatcgatcggttttaaatccgagcttaaggataaatacgaccaggatgaaaatattctgcagaaggtgaccatagaggatgtgcgcaaatttggcatgataccggaattcttaggacgtctgccgatcatgtttaccttagaagcgctcacagaagatatgttagtgcgcatcttaaaggaaccgaaaaatgcgatcttaaaacagtaccagaaactgcttgccatggatgaagtcagactcgaatttgaggatgacgcactgatggcgatcgcaaagcaggcaaaggaaaagaaagtcggtgcgcgtgcactccgtgcgatcatcgaggattttatgctcgatatcatgtatgagattccgaaagatgacaatatcggcatggtgaccatcacaaaagagtatgtggagaaaaagggcggaccgctcattaccatgcgtggctgtgcacagattgctgctgttgaatgagacgatgaaagaatgattctgaaatggggaaaaatcttttttacagactgagaaaaagatttttcctcattttgaatttgaagaatatggtaaaaaagtgttcacactatgattaggtatagtacaatagtactaatcgaaaaaatggaggagtgaaaatggcaaaagagaaaagagaaaaaagaaaaaaataaaaaagcaggaaacaaacagggcatacagtttcagatccagagcaagatcggtgcctccattatcgtggttatggcagtgatcgctgtactggtagtagtggtggtttacaatctgctgatcaaagccaacaacacagagctgcggcaggattctgaagcgatatcacttcaagtggaaaaatatttttcaccgtttgagcgcatggtagaacagcttgcactggatgaagatgtgcagacaattctgaccactaccaaagctggacagaaaatgacagagaacgaggtatatccagcggtactaaagaagcttgtcgcagtggcaggacttggcacggaaaatattcagggtgtattcacggcggatttggacagtaatgcatccattacatcagcaggcggtatttccggcgatgattatgactgtacgacccgcacatggtacagctgtacgcagacaggagaaactatgctgacaaagacctatgttgctgcaagtacaggaaaaacaatcttaagtgcggtaacacctgtatttgacgagaaagatacggttgtcggtgtcgttggaatagacgtagggctggacacagtcatgaatatgatggggaattatacgatcggtgcaaatggatattccatgctgttgacaagtgatggaacttttgtatatcatccgaatgcagatctgattgatactatgattcaggatatgaatatttcagacagtgtaagcactgcgatcagcaatcagtcagaacagcttttgaaatataaggtaaacggtgaacaaaaaatggaagacagcaagaagcagatggcacagatgcgtgaggcaatggacaaaattaaggaatcctcgaaacaggttgtcggtgtcatcaaggcaattaaagatattgcaagccagacaaatcttttatcattgaatgcatctattgaagctgcacgcgcaggtgaggcgggcaaaggctttgcagtggttgcaggagagatcggcggtcttgcagatgagagtgccgatgcggtaaatacgacacgtaacctgatcaacgtatcactcgatgagattgaaaagggaaatacgatcgtaaatgatgtcattgcatctttggacaacgcggtagagcgtgttcgtattgcaaacggaatgattcagaagacagcacaggtggcagatgtccagatgaagagtatcgaccagatccgtgacggcatcagggatatgtcacaggtggtttctgataactctgctatggcagaggagacttcagcaacaagtgaggagctggcagcacagtcagttacattaaatgaacttgtacagaaattcgaattagaataatatttgtggttctaaaataaaaaattccggcatctatttagtaattgaatagatgaccggagtttttttatttatggcggattgcagggaacaggtgtattctgacgaattttttgattttattgtatcttatgaggaaacgaatgaacagacgatcgcagggacgtgtatccagagaattgatgaaggatatgatattttttattatccaagggagggactgcctccgcttagtgtaggcagttattcttattcagagattccaaagtgttatgggctgttggatcagactgcacttgaggtgtccggtattttaaaaatgcagaaccagcccgttctcgccttaaagggaagaggtgtattgataggttttattgataccggggagcgagttataataatgtcaagttagtaagaacccaacaaaatcaagggttcccgctgatttagtcctacgaaaaaatgccaaagtaatggttattttgagtaaggatgagctcatttttatcttcaaaaaatataacttgcactaatataacacgaggtgtatttgaccatttggcactaggggtagtatgccccaaacaacttaataatgtgaatttagataggactaaattagctcttgcgtggacaagttccatatttgtattgctgacttagtcctactttttttgcccggaaaaggaggataaggtttggcgatgacaaagcgagagttaattcagttcatggacgagttggtagagttagccagcgaggaaaacaaggcaagagcaatcttggtaaaagaaaagtttatcaatgactttgaaaaaagctatgagtacgaaaaggaggttcagacagagattacagaactgccaccatactatatagcggcaatgccggatttgatacaggaagaaatcaaggtaaaggtaatagttgtattgacagagtgtggtgagtgtaccccggaaaatgtggaaagagcaatgagttccaaaatctatgacttagatgatttgattgatattaaggagtatgtcagacgcatggaagaggaacagcgaaagaaagcagagcagaaacgggggaatggcagatgataaaagcaattattggtataggagttgctttggtgtggattacattctttgcacttgttaaaacagcaggtatggcagacagaagattagaagaaatacagaggctttccgccgagagagaggcgggtggagtgtgtgggaattaatgtaaaggtacagaaatctccgaagccgagagatattgtaacagcagaggcaaaattagagagagatttgaaaagctgtatgcggtgtagattttttcacggtaacaatcgccaatgtatagcaaagaaatgtgttaaggaagaaaagaaacagacggaaataacggttgaagaaaagcagagtaaatgctttggatgtccatatctgcatacagaagggtattgtttcccttgcatgaaggagattttaggacttattaagaaaccaatagttatcgaacaggaggaaaagaaagatggataaacatattgaggtagtaggtgtggatcatggctggtctggaatgaaaacagttagtcaggtatttacaaccggagtaaaggaaattacaacggaacctgcattttacaataatgtagtagagtttaacggttcctattacaaggtaggcggtaagcgacttgaggtaagggatttgaaggtagaaaatgataacttctacattctcacattggcggcggttgcaaaagagttaaacagacgaggaatgagaaatgcaaatattctcttatccgtagggttgcctcttacaagatttggagcagagaagcaggacttcatcgactacttatcaaaggaaaaggaagtgaccttcagatttgataatgagcagtatcgtatcaaacttgcaagggtgtcggtgttccctcaatgctatgcggcagttgcagacagaatgaagactctcccgaaaagggttgtggtggtggatattggaagctggactatcgacattatgccgattgaagattccgcaccgaatgaagctgagtgcatcacaatcagggaaggcttgattaagtgtatgaggacaatcaacgaggaatgtatgagacagtatggtaaggatctttcagaggaagatatacaggaaattatgagaaccggaaagcatgagaaacttcctcagaagtatttgaccatcgtggaagaatgcctcagagcttatgtagataaggtttacaatattcttttagagcatggatataaccttgaagtgacagaaatagtatttgtcggcggtggagcaaatgtggtaaagcgtttcggcaactatgacggaaacaatattcagtatattgaagatgtcaaggcaaatgcaaagggatacgagtatcttggaaaactctatttagcaacacataagaaagagtttggattggggtgatgtaaatggctaggtcaaatgttgcaaatcacagtttgaggcttaatctcgataatgaacagcataggcgagtggaaaaggttttagcaggtttgaatctggatgtgcataaatcaatcaaccaattcttggtggaggcggcagatgcttatatcagtaggttagaaggtagtgacctgacttatgaagatgtaccaaagaaagaagaagtccgctacattacaagggatgacttagaagaattacgcagggagattaaggacgaactgcaaaaggagatgataagcatattaggttcagctcttattaccgggaaagtaattcagatgccggaagtcagaacggtaagagaaaatacaaatcaaaaggaaaatgaagaagatatgagtgtaaatgaaaccacaatgggacttgtttcatcatggggataacggaaaggaggaactgttatggcaggaatgattttaagaaagacaggcgcggtattacttaccatattgaagggactgctttatgcagcgttgatgattttgaaactgttatttggtggcttgaagttgttcttgctgttgcttgctttggttgtaagggtgctgttgtctttggttgggatagctgcacatgattaagggaggtgtcagtcatgtggagatataagttttttatggcacacaagaacaatgccagagctaagagacttatggcgtacatgaacagaatgtagcaaaatatcaggaggaagatatgaacagaatacgggatcagccctaatagggagagttccgtaaacagtcaaataaatacagtacccattgagggtaggcagtttatggagcaataagcctgtccctcaagggagagaggacaggtgatattatgagaagattatttatccttttaaccgtttgtaccctgattttggtaggatgcggcggtcagatagaaaagccgataacagaaagtcagagcatggagacgacttcacaggtggaagaaaccgagactgcggagattgtggaaaacgaagatgtagatattgcggaagtggaaagtacagaggaaagtgtacaggcagatgcagaggggagcaaggtagaaccggagcctacaacggagccggaaaaaccacagcaggaggcagaacagagtaagccggaagaaactactccgtcacaggaggaaaagccggaaccggaaccacctataagcacagaagctcctacaccagctccgacagaaccggaacaaccaaaggaacaacctaccgaagctccggcagaagtggaaacagtagcatatgatccttatgaagtggtttcccttgcaacagctaagacgaaggcttatggtaagatttccataccggaggatttagataatatgctcgcaaacggtgagataaccaaagaggagtatgatgaatactatccttacgatggagcaggatattacagcgtatttgtagaaacagatttgaatcaggcagctaccacatcaggcaggaagcttggttcggtagatggaatagcaagctatattgcagaaatgctttcccttgagacaggtccttatttctacatagagtatgcaggtgttcactccattaacggtacagacttctatgagttcagatgttatcgtgcataaacaaaaccaaatatgaggtacaaatagcaggctgatatgtagcctgttatttttttgcccgattttgaggaggaataaaaagtgaaacagagattgaagcgatttatggcaggatttttagccatgttgacggtatttacaactttgtttaccaacggaacaacagcctttgcagcaagtccgagtgcaaatatttcattctggcacgcttctacaaaggattctggagaggtaagtgagttaaagccgggatacaatcatggaaaaatcctttatgcagtcattgacggaaatgcagcctattgtatgaatttcggtcttgcggctgacggtggacagcttatgaacagttatgagaactcaagcacaagcatgagtgcagagcaggagaagttgttaagctactgcctgtattatggctatggcacaaatagtgcaacagctccgtccaatgatcagtgtgaccagttcattgcaacacaggcaatggtatgggtaatcgttgcaaatatttatggtacttcgagtgcggattctgcggctcagaagctctgtaatacagcaccgaaccctacaagctcatataattactacacatcattaaagaacagcatcaatgcgtcttattatgtgacagtaccgagcttttcagctacaagacagagtaaggctccgacttatgagctgaaatggaatgaagcaaatcagagatttgaaacaaccttaacagacagtaacggagtgcttggaaacttctcgatttcccttagcggatattctgttgaaaagagtggtaacagcgtgactatttccagcacatcagtaaatacaaatgcaaccacagcaacaatggattccacaatcggggcagttgagactacaacaagctgtgtgttctggcttactgacaagtccggttatcaggaatttgtttctgaaagaccacaggctgacccggttcatgcgtatttcaaggttaaaaccgagaatatcggttacggacagattacaaagcaggatgaggaaagcggtgtgaagttatccggtgcagtttacggtatctattccgacagtagctgcacaaatcttgtagataagttgacaacaggctcagatggtaaggcgaaatcaaaggctcttgtagcaggcacttactatgtgaaggagattactgctccgaaaggttatgtgcttagtgacaaggttcataccttaactgtaaaggctgggcagactacttcctttactgctacggacaaggagcagcttggagccattaccatttacaaagagggagaagtgctttctggttggaatggtacgaacttcacttatgaaatgagaaagctgccgggagcaatttttatggtaacagcaggtgcagatatttataaggcagatggtactaaagtgtataacaagggcgatgtgattgcagaaaaccttgtgacaggaactgacggacaggtggtgcttacggaccttcacttaggaacttatgtggttacagagacaaagagtattgacggttatactatcaacaccacgcctcagaccgtaaagattgagtacaaggatcagactgtaaatgtgcagtacgaagcaactaccattcagaatgcaagacagaaagcggaagtatccgttgtgaagaaggattctgagacagaaaatcctcttgatggaggtaaatacactctttatgccggaaatgatattaagaattatgccggacaggtcatcgtgacaaagggtactgcattacagaccgtaacaacaggagaagatggaaaagcagcttacacattggatttaccgatttcaaacagctactatatttccgaaacacaggctccttacggatatatcagaaacagtagtgatgtttacagtttcaacttcaattacctttctgaaacaacaccaaaggcaacctttgcccatacttttgagaatgaccgtaccacagcaaaaatctatattttcaagatggataaagaaacctgtgtagccattccacagggcgatgcgtctttagagggtgctgtatatggcttgtatgcccgcaatgacattgttcatcctgacggagcaacaggtgtggtatttaaggcaggggatttgattgccacacttaccacagacaagtatggtgaagcagaggtagataacctttatctcggaaattattatgtgaaagaaattactccttcagagggttatctcttggatgaggaggagcatgacttagtatgtgattatgagggcgacatggttgcagaggtttccagaagtacaacttctatggagcaggtaatcaagcagcctttccagttaatcaaggtttctgacaatggagaggataccgaagcacctttgctttcaggggcaggatttacagcctacctcaaatcttcattatccgtaaaggaagatggaagctatgattttgagtctgcaacacctgttatcatcggtgcagacagaaaaacagagattttctctgatgaaaaaggtcatgttgtatccattgcaattccttatggaacttatgtggtgattgaatctacaacacctcataacatggaaacaatcaagccttttgaggtaaagattacagagaataatcctacaacacctcagatttggagagtgttccttgaccgtgagtttactgcaaagctccgtgttattaagaaggatgcagataccggaatgacagttcttattccgaatacagagtttaagattttcaatatggataccaatgagtatgtggaaatgattacaacctatccttcaaaggaaacacacacttcattctttaccgatggtgatggagatttgattttaccggatgtattacctcttggcaattaccgtattgaggaagtggcagccccttatggttatgtaatcaatgacgagtatgtaactgtaatggtagatacagatactttctatgaaattgatcctgacacttacgaagcaatcattacagtagactatgtggatgagcctgctgttggtgagcttactgtggaaaagaagggcgaagtattagacgcatacaagggtggtctgtttgcagattctgaagaaaaggaatttgtttacaaggaaggctcccttgcaggtgcaaagtttgaagtatatgcggcagaggatatttacacagccgatatgcaggtagatgaaaacggaaacagaacaaagtattattccgcaggtgatttggtggcaaccattgttaccggggaagatggaaaggcaactctttctgacttaccattaggaagctataaggttgtggaagtggaagctccttatggatatgtattaaacaaagaagaacaggtagtgacatttgcttatgtggatgacaagactcctgtgatttatgagagtgtaacttttgcaaatgacagacagaaggttgatttatccgttgtgaagatggataaagaaacagaacttcctattgcgggtgctgagtttggcttgtacgcaaaggaggatattttcaatgtggacggagaaatcatcattgaaaaggacactttacttgaaatggcagtatccggtacagacggtaaggtagagtttgttaaggattatcctcttggcatttactacgcaaaggaaatcaaagcccctcttggctatgtatcttctgaggaaatagtggattacaatgcagtttatcagggacaggatgtaaaagtcgttaagctggagtctgaatttgtaaatacacctactacggtggaaatcacaaaaacagacattacaagcaatgccgaattatccggtgcaactcttactgtaactgacagcaaaggaaatgtgattgatacatggacttccgtagcaggagaagcacatgtaatcaagagactccatgtaggagaggtttatacacttcgtgaggaatttgctccttatggatatttgcaggcagaggaaatccagtttaccatttctgatacagaagatgtgcagtatgtggaaatgcaggatgaagtaccaaccggaactattgttatcaataaggacggagagttcttaactgacatcaatctcatcaagggacattggtatgattttgtatttgattacttcaagaagtcccttgcaggtgtaacctttgaagtttatgcagcagaggatattgtaagccctgatggacttaatacggtttactatgcaaaggatacccttgttgcagaaatcgtaacaaatgataagggtattgcaagcattgagaatcttccattaggtaagtattatcttgttgaaacaaagactttggaaggctttgtattagacagcgagcctatcatggctgacttatcttatgtggatcagcataccgaagtggtttatgcaggtatggaagtaaccaatgaaagacagaaggtacaggtaactgtaatcaagacagatgcagagactaagaaagaacttgaaggagcaatttttggtctttatgcggcagaggatattgtaaatgcagacggtaaaattatcgttgctaaagatacccttgtggaaaaggctgtgacaggtacagacggtaagtgtgtatttgtgagtgaccttcctcttggacagtattatgtgaaagagattgaagaaccgaagggatatgtattgaatgaggaaatcttcgcattagacgcttcttatcagggtgatgatgtgaaggtcattgagttggaagctacttttgcaaactatcctacaaagcttgaaatttccaaaacagatattaccggagaatatgagttaaagggtgcaactctttctattatcgacaaagacggtaatgtagtggaaacatggaagtctgacggggaaactcactatattgagcgtattcctgttggagagtacatccttcgtgaagaagcagctccttatggttataagattgccaatgaagtgaagtttactgtagagaacacaaaggtaatccagaaggtatccatgaaggacgagcttgtaagcggtaaaatcatcattgagaaaactgatgaagtgacaggcaagggcattgcaggtgtagaatttgaaatccgtgacaaggacggtaaggtaattgaaacacttgtaactgacaagaatggtcatgctgaatctaaggaacttccgattgctgtatttaaggatggcaatttcgtagaggatattaaatactttgttgtagaaacaaaagcggcagagggttatatccttgacagcacacctcacgaggtagtgttgcagtacgatgatgaagcaccggaggttgtaacttatacactcagcttaacaaacaaacctacggaaccgaaacttcctcagactggagataacatgaatccttggctttatgttggaattggacttgctgctattattacaggtgtctttactttccgtaagaagaaaagtaagtagttttttcttggctctattagcataatgtatatgctaatagagctaagtttacatagaaaaaacgataaaagcatgataaaataaaatctatgagttatatgacatgatgaaaggttgatatagaatgaagaagaataggaaaattaagaggtttatttctttaataaaggacggaataaggaactttattgataaattgaattggcattatattgtaattactgtgattattttagtggggattggtgtcttagttggttcatattggatatctgatccggaattgaaaaatattgcagtagggttaggaacaggaattgttacctcagcgttggttactctttgcattgatcttatgaatgctaggatagaacaaaggaaattagcaaaatataagagaatgttattaaacccgttatgtaatgcaataaaaacgttgtatgtgcaaattgcgttgagtgtcaatgagtatcgggtaagggaagaaaaggggcattactttttacttccgttggaagatacaaaagaactttcacattttttcaatgaaatgaaagacattgatatagaaagtgttggtgatgaaaaaaagaaaaatagacttgtggacttcatttcggtttcatcagtgtatttaaaagaagtgattagccaatacgaaggattaccttttgagagtttgatattagataatataataacacaagaagaatttgaccaactaaagcgttttaccttagtaaatgagtgtaagaaatgtcttggtatattaggtgataaaacattatctgaaaaagacaggtataatacaagcgttcaattacttcattgtatgatgctgtttattaacagattgatgagaatatttgactttattgccttgaaaattgaaatagagaatgatggtattaagaaacatttagatgatatatattacaatgaaatatatattttttctgatgaatatgttgagcaatgggcagaaagagcagaggcagaagcagaatattatgcggaacatccggaactgttagaagaagtagaggaaagtgaagaagaacagttgcacagaaaaataaataccgcaatttgggcaggagatgtagaaacaataaaggcatgttttcctcagattgataagaataataaacagatacagtcggaattgacttggagtgttgcaaaggatgttatgaaagataaggtattacaagaactgtatttccaaaagtatggaataaagtataaagtgagaaaagacaagagaagaaagcagtagggttgttaagccgaggaaggagtccccggcttttcttttaccctaaattcggaaggagttgaaaatatgttgattattaagcgagggattccaccttagtgtacaggtgggattttatttgaaagagaatatagtaaattgattgagccgaggagtaaaatccccggcttttttcatgcaagaaggaggaactttttattatatgatgaaatatgaaattttcaaggaggtagtagctgatacattcaaagactacctgccagaacagtataggagtatggatttaagagttgaatccgtaaataaagtgaatcgtatgttggatggtatcactctggttagtgcaggggcagataaaaatatttcacctactgtttatatcaatgatatgtacgatcactataagctctgtaatgatttgaaggaagcaatcagatccggagcagacagaatggtaaaggcatttagtatttgtcctgaaatgcctaaaatcgaattgtcagaagcaaaggataacattgtatttcagcttgtaaacacagagcagaatagagaaatgttagcaggaataccacatcgagagtttcaggatttagcggttatttaccgttgggtggtaaaagtggaagcagatggtattcaaagcacaatggtaagaaattcgttagcagagcagcttggattaaatgaggagcagttatttaagttggcagtagaaaatacaagaagaaaatttccgccttgtgtaaagtccatgaatgaagtcatttgtgagatgtttgttaaggacggtatgccgagagaagttgcagaaatgatgattggagagatgcccgctgacaagatgatgtatgtgatttccaatgataagggaatcaatggagcaatttctatgttgtatgaggataaacttcatacgcttgcaatggaactggaaagtgatttatatattcttccatcatctgtgcatgaggtaatcgcggtctctgctgaaatgggtgatccgtatgaattggcagaaatggtttctgaaatcaatatggaccaggttgctttggaggaacgattatccaatcaggtttatcattatgacaaggacttgcgtaaattaagccttgccacagatactccgaacaagagattggacggaattgtggcagagccgcctatggtttatgaaacaaagcagtccagataggaggcttatggaaaaagaagtaaaagaggttacggtggaagaactcaaaaaactgatacagtcacaggaaggagagtttataatccgtgtggaaccgggagagggggatgccgatgggaaaacagaatccgtttcagcttgatgtggtttctgtaagactcgtaagggatgctcccattttttctgagcagaagatagtaaatccggagagtgccatagcagttgtgggagagcttctatgtgaaatggacagggaagtggtgtgtattatcaatctgaaatcagacggaacaccgattaactgtaactttgcaagcatgggagctatcaatcaggcgattgttgagccgagagagattttcgagagtgcaattctttccaatgcagcagccatgattatggtgcataaccatcccagcggaaatctggaaccgtccaaagaagataccatgataacggacagaatactgacgctgtcagcctatatgggaatacctcttaaagaccatgtgattgtaggaggagacaatagtggttatttcagctttaaggaaaaggaacttcttaaaatgccgaaagtatccttaacccaaaactatcattatcttaattttggacagtctgcaatggtagcggaacgaggaaagagcaggtgatgatgtggaagaaagaaacagttttaccaaagaagaacttgtcatagcaaagagtgtggatttaacggatgttgcgagaaatcttggttataccgtaaaaaaggtgggaagctatttcactttaaaagagattgattcccttcgaatctataaccgtcggagttggttccgttggtcaaaagaatatgacaagggagagaatggtggctcgcagatagacttccttcgtgtgtttgcaggaatggaagtgaaggaagctgtattctggttgcttgattttgccggatatagaagagatgaggaatggaaaccgaaagctgccattgtggaagcaaaggtagtggaggagaaagtaccgtttgtacttccattggctgcaccggataatcgttacctgtatcagtatcttatgtatgacagaaggttatctaaagaggttattgaggcgtttgtgaaaacaggacttatctatgaagagggcagataccacaacattgtctttaagggtaatgacagaaatggaaataccctttttgcaagcatgagaggtgtgtttgaccggaatgggaagtgttttaagtgtgatgtggcaggtaatgataagaattacggttttaatgtgtggaatgaggaaagcacggagatagaagtctttgagggtgcgatagaccttatgagttatgcagacatttatagtgattttcatagtaacaagctggcgttaggaatgttatctgatgcaccgcttgttacttttttgaaggaacacccacagattacaaccattaaattctgccttgataatgataagccgggcagaacggcaacagaacagctcatgcagaagtattatgaacttggatatgaggttgaggattgtccgccaccaaagaactataaagattacaatcaatggttgaaggaggcaaggagagaaaatctgcaaatcgggaggtgtgtggaaatggcaagataggaataattgaaaacttcaattagcgatgcggatagtaattgaaattgtcagttacacttccaaaagttaattgaaaaattcaattagtgttttgaaagaaattttttgaccagaaaatggtggagccctcgtaattgaaaaagtcaattaacaatgcaaaaagtaactgaaaaagtcaattaactatcctatttataattgaaatattcaattacccatataaaataagcggggttttaggggcagccccctaaccagaggcacttgtattacaaagtgcgtatctggcaaattcccatagggaatttgggcgggaggaaagatttggaatgaaactaagaacagttaagaggaaggtggtagagttggatgtaattgatgtgaacagcaggcagttgcaggaagtggaaattatgggacattacggagtttttacagagctgcgtgtggataaaagtacccttcccgaaggcgtgaactgctatgagcttaggcacggtgaggatgacagttacccggcagcgatggagcagaatgtaagggtaaactactttggtgcagtccttatgacagataagatggaattaggagaggatggctatgtggagcttacctttgatgatttcggatttaccggagatgatttaaccatgcttgagtaccgggcaaattacttggaggaaccggaatgcttttccgatgccaaagagttggttcagttcatgggtgcgtgtgacacaccatttgaactgacagaaaccgaagcagataaactgttaggatatatgagtgggcatgattttctgcttggggaaaaggaaggcaagctgtttcgtggagatttgagttatcagacagataaaatcagatggagtgaggattccattgacgatgttatcaatgaagtgacggaatggaattatgaaatgttgaagcaggcacaggctgagatggaaaatccgaaagattttattgactttgcaaacaagaaagctaatgcagatacgcttgcagaggactatgagatattggataagctgtttgaccgtacaaagtatggagtagagatagaagcacttgctgtaacgctggcagatgagtttattcaacacctgcaatccaaaggtggcatagacggtgcaatccaaaagatgacggaagccatcgcagaggggcaggatctgttgccggaggtatcgcctgagttaaagcaaaggtcagggaaggtgaggtaaatggcaggagataagaaaacggtggtaaagcctttccgtatgacagaaaaggaagccgaaaagctccgtctggatgccgagcagagagggataaaggaatcagaatatatccgactgctattgtcacagaagcccaatgattaccctgagatacgcattatgctccgtgagctgataaatgaagtcaatgccattggcaacaatatcaatcagattactagaaatcataattcaaagctgtaccgtgaggaggacagggaacttctgtcagcctacatgaaaaagctgaatctgttggtaaaggaggcagtagaaacgattggcaatcagtaagatactctatatcggtgactgtggttcgggttatgtgggtaagcatttaaaacaggctcttgactatattgtggaggaacacaagacgggcgagggtaaatgggtatcttccctaaactgtcaggtggacagtgcctatgagcagatgcggcagacaaaggtgcagtttggcaagacggaccagaggcaggggtatcacatgattatatcctttacggaaggagaggttgatgccgagactgcatttgaagtcataggtaagtttgtgaaagagtatctgggacaggagtacgaagccatctattccgtccatgacaatacggatcatgttcacggacatattattttcaacagcgtgagctttcgtacagggaagaaataccgatatgaaaaaggtgattgggcaaggaaaatacagcccataacgaaccggctttgtgaggagtatgggttgtccaccattgaaatatccgatgaccgtgcaagaccgtcagagaattgtaaggaatggaatgattttcgggatggtaaatttgtatgggcagatatgataaagagggatattgatgcctgtatcatgcaggcagcaacctatgagtcatttttagccatgctttcggaaatgggatatgagattaaaaatgcctaccggagcgagggaaaatatcttgccattaagccgatgggactgacgaggttcaggcggtgtaaaagtcttggagaagattatacggaggagcgtatccgtgagaggattgagacagaaaatctgtctacctatcggaaacttagtaaagagcaggaacctaagattgtccgttgcagagtaaaacggtacaagagggcgaagctgtccggtgtgcagaaaaaatactttgcaaggctgtaccgattgggactgttaaagaagcgtccatacagtcaggcgtggaagtaccgtgacgatattcgcaaaatgcagaagttacaggaggattatctgtttcttgtcaggcatgatgtgcagacggcggcaggtgttgcagttgttgcagagagtatgacagataagaaaaaggacacttccagagaaaaaagccggatatttaaggagagggcaagaatgaagccactctttgatatggtgtcggaattatcggagcttcaggaattggagaattgttaccggaatggtgaggagctgtttgaaaaagaacataagcggtatgaggagttatcacagagacttttaaaggaaggatatactgtggaacaggtggaagcactaaagctgcattacaaaaatgagattgcgatggttcgggataaggaaaaagcagtttccaaagaagaacgcattgcaaagcgtattttagcagaccttttaagtacggataccggaaaggagcagtcaaaagaaaaagaagaaaacaaaaaagtggagaaaagcagacagccaattttataaggctgtattttttatgccaatggaaggagggagcagatgcaggagagagccagagtgagcagtatggatttaaaggcacacatgaataacctgcgtaagaatcctaagtttaccgaggagatattaaaacttgtggaatcggacttgcagtatggtcttaccattgaggaaacggaaatgtatacctcaaagcggtttgattatgcacagatgaaggtatattcggcttgtttaagaaatggatacccggaagatgtaagggaatgtatcacaagagatgggcttacaggagagcagatggcagttgctcttgagttttatgaaaagggcgtaccgttaaaaaccgtagcagaggttacggaaaacagctctcatacagcttttatgatgaaaaagctctttcagagtattgtaagtaaggtgcaggcggcaggagaggcagtacaggcacaggatgactatgcaaaagacctgttagagcagattaagtcggtggtggaaaaaatagagtttcaggagaaacgctatgatgccttaaatgagaagctgaaggaattgcagacagtcgggcaggatgcaaagatacagaataatcttttgagtcagcttgcggaaaaggacagtatgcttgaaaaacagcagaatgagttaaatgaggcaagaggtacgattgcaaggcttagaaatgaaatggatgttatcaggaaggagagagacagattggagaagcgaactgaggaaatggaaaaggaaactgtcgtaaatagcaatgaagcgaagcatccggagattactatgacggataaaaaggaagaaacaacgcatgcggtgcaggcagaggtaaaacaggaagccattgtttttccaacttttccgggagcctactataatgtggcagttgtggatgggaacggtaaggttgtgtcctttatgcccgtagaacgcatggagcgaaaaagggagaaaagcaccatgtcagcaatattttccagacttactttcaggaagaaaatcgacattgtgaagctggttgcagaaaaagaccttgaacccaaacagcttgtgcagatacgaagtgccattgaaaagggtttaagtgaggaccagctcttggtgcttatcaataatcagattccggcagagcagatggaggagattatcaatatcgcagtctatgagaacgaacagaagcaggaggtttagtgcatgggtttggttgcagtagcggaaacagcagagctaatcagtgcaaagcaggtaacattatcggagacagacaaggaatttgtggttcagtttgcttttgcgacaggtgataaggaactgacaaacaagctgatagatgagcttgcctgtgagggtgctgataagggtgctgtgcttctaaaatacagtaccatgacaggttttcaaccggattggatcagaagaatagaaaatctgctggtagcgttggagatgtaccgtattcaggaagaaaaggcaatacagacattgtcggagtttcttactgcctacggagctgatttgacggtggaagaaattaaggaaatgccaaccgataaggtcagggagcattttgaaaagaaagaaacaatgatgagataggaaggaggaggcagatgtcagaagaaatacaacaggcggtgcagattatccgtgttgcttatgacgggattgagattgcaatgaaaatcggaagcggttcgcttgaacagatgaaaaaggcagttgattttctcattgccattcttgaccatgagaaaacaatgggtaagaccgatatgcgaaagctcttgatgaagggcggcgatttgcaggttttacagtttgcaacagaggatatgaagcaggtggagaagatggcaaagaagtatggaatcctttactcggtgttaccggacatcaataaaaaggacggtatgagtgagattatctttcatacggaggctgtgcccagggtaaacatgatgatacagaagcttaaatctgcaaggattgcaacttttgacgattacttgaaaaacggaaatgaaaaagaccttgagaaagtaatgtcttttctaaaggggcagaaaaagggaaacgataacatccacacggcagaagccaccagagccggagaagccttagaggggcttatggaaaaggtcggcatgtatgcaatggaaaagcagagtgtcagtgtggaggagattaaggagaacttcaataccacgacggaacaggcagaaaaggttgtggaccagcttgaaaagattggtgtacttgataaggctgataacggtcagcataaggtaattatggataaggaagcctttcttaaccgtatcagaggctataaggagcttgcacagcgtatgcagaatatttctgcagcacagagtaagaaccttgtggacattaccattaccaaaaagctgattgtggaggaaaatgaccgtgcggttaagaccagagttcccggtatgtatggggataatgcaagatatatctggattaacaaagaaaacgcaatggacattcacgatggaaagaccattcttaccttccttgacagcgataagacctataagctctattcggaggacaaccgtgttgtcggcacgatgaagggaaaggacttatacgagggtcactatgatagcgtggcggcagaggtcagaaagcgttacaaggaagcggaaagaaaagcggctgccatgaaaacaaagcagaaagctcctgcaccgaaaaagaggtagctgcctatggttcctaagaagaaaaaagtatcactatggtttattattcttggtgccattttatcgggatatgcgggttatctgctaaatggggcgtgggagccgggaggggatataaattcctttctggagtccttcaacaatgtgtgtgctgccccgtttgcaaattattataatgagaggacgataaaagcgatagtcattgccttaatggtatatgctgtcgctttactcatgtatgttacaagtcagcgaagctttatgccgggtaaggaatttggtacggcaaggtttgaatcgccacagtttgccaataggattctgatggataaggatgcttcttttaatcgtatcttaagtcagaatgtgaagatgtcccttgatttcaggcgactgaaactaaatggcaatattctaatctgtggtggttcgggagccggaaaaaccttctacgaggtcaagccgaatttaatgcagatgccccgtaactgttcctttatctgtactgatcctaaaggggaaatccttagaagctgtgggcagatgttaaaggataacgggtacaatgtgaaggttatcaatctcttggaaatggagaagtcagattgttacaatcccttttcctatctgagagaggaaactgacattgtgaagctgattaccaacctgatttccaataccacaccaaagggtgcaaccccgtccgatccgttctgggagaaggcggaaggactgtttttacaggctatcttttattatgtgtggctggaagaaccaccggcacggagaaactttgagacagtcttaaagctgcttggagaagcagaggttacagagcagaataagccttccaaactggatattcgtatgaagtttttggaggagacttcgtcccttggctcggctcatccggcagttaagcagtataacaagtgtatgcgtggtgcaggcgatacggttcgttccattatcatatccgcaaactcacgacttgcctttttggaaaacaagcaggtgcttcgtatgctttcaaaggacgatttgaaccttgcagagcttggtatcggtgtaaatggtgatggagaaacaaagactgcattattctgtgttataccggatagtgacaagtcctataactttatcattggtatgctctatacacagatttttcaggagctttactatcaggcagactttaactgtggaggcagactgccgattcatgtaacatttatgttagatgagttcgcaaatgttgctttgccggatgattactgctctttgctttccaccatgcgaagcagggagatttcaagtatcatcatcattcagaactttgcacagctaaaggcactatttaaggatacgtgggagacaatccccggcaactgcgatacgttcatttacttgggtggaaatgagcagagtacccataagtatgtgtcagaattgcttggaaaaggtacgattgataagaaatcaagcggagaaaccaaaggaaggcagggaagctccagcaggaattatgatgtgcttggaagggagttatttacacccgatgaagtcagaaagctggacaataagaagtgtcttatttttattcgtggattcgatccgattatggacaacaagtatattccattcggacatcctgcatttgcccagacagcagacggaagaggaaagccctatgtgcatatacagacaggacagaaaaccgtagcagaacagccatacaggatactgtcacccaaagcagtagcttattatgagagcttaaaggaaaagggagaaaatgtgtatattgataccctaacctatgaggagtttggtgtgctgacagagcttgatatgaaaaagcggtttttaagccttgatgagaaggaacagagggagcgactgaaccgtgagcaggagaatgagttgcagtatgcaccggaacctgagcagactaccgttacggaaaagcaatctgaaccaaagcaggagaagcgtaagttagtcggggaagataccattatgaaccgtatggcacaatggcagtattccaaagagcagaaagaggagcttcataagatgatggctcttggcatgacaaaggcggagatacttgcagtattttatccggaaaccgatgttgcaaaaatgagggaaatcagacgcacctatcgggcagttaaaacaaatatctagccgcttagagtatttccaaacccgaagcaaaaaataatattaaatgaaaaggagcttataacatgaagaaatggttagatagtaataaagtagctatgcttacaggggcagcaatacaagatgatgaaacatttaagtcagaaggtggatttattcccgagagagaccaatattattttcagatgcaacaaggtggtaatgtctttttagttggttttaaagatttgctgacatgtttgagactgcttgaaaagctgggggaaattcctgaaatcggcgataaatggtggttgcggatggctacactttacggaaatgatatccttatggtagaatttaaggaagaagaataaagtcgatcacaggaggcaatatcatgaaagagattaaatttactactaactatgaaccggttttgtcctttgttgataaggattttaaaacaaaatatgaagaacgggttgggaataatccaggctatatacaggtagttagtggagagacaaaacacttagcgttatgcccccgatgtaataatccagtcgctattcttggtatttacaagcaaattgatgttgctccccatgctagacatgctaaaggaattaatattcctaatgtagttcagtatgatgaatacaagtttcagaattgcccttatcacaaaaaaagagctaattatataaaagaatatgttcctgagacagaagaaccggaaagacaggaattatttaggattgccaaagagcattatgataaagctatttatttgttgcaagaagaaacaggtatttatataacgcttaaaatggctgaaactctcgcagaaaactatgtaaaaatgcgagcgtataattatattgatgcaacgatttataatatcccgtggtatttaatctacagtttcactggtttcccgttgtatcacatgataataaagaaaaacaccacattatatagacatcttactcagcttggatttgttctaaaagatagtaaaatcaaagggcatgtttatgtagaaaataacgaaggctatttgcttacagccacgaattatagatatgtggtagatgaaaacgataaccttaacgagtggttggatttttcgattatacgaccagatgccactgtgacagatactcttttatatgttccagtagaacgattttccgttagtgtagattcatatcattttggtaatctgattaattatcaaagctggcgtacgcgacagaacctgttagatatcgctaaaagatatatgaaaccataatttgtttgacattttcctaacgtgtagggaaagacgaacacttacgagtgaagtaaatgtattaattgaatttttgataaatgataaagcagccaagttgggctgcttttttgtgcttaaaaggaggtgattcagatcataacgcaccggagaaagcccggtttactttcattgcgggaatatcccgttttcatagataacagataacaagacagaaagggatgtgtaccattccattcggagaatgagccggattggaatgatacagattcctttccgccttagtctccgttatttctgtccaaaacagaaaaggagattagagattatgcgtaaaaatgaagttgcagtagtagaaaagaaggaaaacaaaggtttatccaaagtaaagaaggcggtagcggcggcttgcggtgcaggctatatggcaatgaatgccatgcctttaaccgtatttgcggcacaggctggtggtacacaggcaatcacacagccccttgataacttgaagactctcgtcattgccattatcggtgcagtcggtgtcatcattcttgcaaagaatgttatggagtttgcacaggcgtatcagcagcaggattcctctactatgaactctgcgttaaagggtattgtagccggaattatgatggcaggtatttccacagttcttactttcctcggtttctaagagtgtggcagttagaaagacaagagggcaacgaatatcagttgtcctcttaaccgtaggaaaggggtgagaattaagtggatatttttaaattaggtgataaaatcctcgctcttttggaaatggtgttcggcttttggaataatcagatttcattggtgtttgccatgcttggacaatcaactgttgactttaagggtggaggtccctgggcagcgattgaggcaatcaatccgattttcgttgcagtaggctcctcgcttgtggtgttgttctttgtcataggcttttgctcggagagtgtggacatcaaagaggagatgcggtttgaagtaatcctaagaatgttgattaagctggcacttgcagagtggttcgtagcaaacaatgtcacgattatgaaggcatttttcacaaccataggaaatcttgtgaatgccctgacagccggaacaagtaccactctgactattaacagtacacaggcagacattatcaaagacctcggatttggagagagtctgattatgctgattttggcagctctcttatccgtaatcatcattatctgtggtttctttatgatttacaatgtgtacttccgtttcttaaaactgcttgtcattgttccgatgggttccattgcgttctcaacgatgggaggtaacagaaccgtgagccatacagcagtaacctattgtaaatatttcttatccgtatgctttgaagcagtcacaatggctctggcgattgtggtatgtaatgcctttatcaatgcgggattaccatcctttacgggcaactatgcggattgggcacagacgctcatttatctgtgtgaaatgacatttacgattgcgttgactgtgggaagtgtcaaaggggctcagtcattaacaagtaaggcacttggattgtaggaggtagcgatggaaaaagagaaattgatttataaatccgaatacaccggggacaatgaggtcgagctggatattcagacatatcacaacaatggtcgtatctttattggtttgattaccaatgaggacgggtatccggaaccctttggggatgtaactgtcaatatagatgcaccggcaccggactattgtggatatttggatataaacaacctttccaatgtagagaatttcattcgtgagaatgatttgggtgagtttacaggacttacgggcagaagtggtttttgtgaatatccgctgtatctgttcaatgtggataagcttcgtgagctttgtcctgaacagatggcagcctatgagtatagtatcggtgtcacaggcaaagagcaggaaaaagaaaaagcagataggagtgattaagttggtaattgaaatcaataaggacattgaccgttacaaggaatccgttgtcatgggacttactgcaaagcagcttatttattctgtggcttcggtagttgcaggtggtggcattgtccttcttttgtatccgtatattggactaactccgagtgtgtatgtggcagttccggtggtagcaccgattgccctcggaggcttttattcctataacggtatggggttttatgaggttatgggaagaaagattcgtatgatgtttgcaaaccaccctctgacttatgtttccacagaaggggaagccatgttaagggagtgccagcaggcagatgtggcaaagaatgtcacgaataaaaagaaaaaggggaaggaagccccgaaaacaaaaggaaatcaggaggagtttgaggctatgaagaagaaaacaaagaatatgttaatcggtgtggtagcaacaatggtacttgctgttatcggtgtggttatttacaaggcaagacagtaggtaacgaagtagcaagagataagaatataccaatctttcacggttgggcaattctggtttagcggccgggattgtccggctgcggaaagtgaggtcaaatttgggtttatttacagacggatttaaggagctgaaaaaagcaagtgaacctttgtataaagcacctaaatccatacaggaaacgattgagattatgaaagtagcagaaaacggtatttttgaggtggcaagaaaccgtttctcaaagtgctaccgttttcaggacatcaattatacaaccaccaatgaaattgagcagattgatatttttgagcgatactgcaagttcttaaactctcttgatgtgagttttaagattaccattaacaataagaataaggatatggagcaggtaagggactttgtattcttacaggatatggacgatggttttaaccatttccgtaaagcctacaatgacattatggagagaaaaatccatgagggcagacagggcattgaacaggagagatatttaaccattaccattgagcgtaagaattttgaggaggcaaaggcacagtttgcaaccattgaagcgtccattcacaaagcatttaatgagcttggtgctgagattgtacctcttacgggcaatgagcgtatcaaggtattgcacgacttctaccacttgggagaggaaaacagttttgattttgacattaagactgcaagaaaggtcggtgcggacttccgtaatgatttgtgcaacaaaatgatgcagttttaccctgattacttcaaggacgaaaagaagttttgcagggcattgttcatcaagaaatatccgtccagcttatctgacagatttcttaatgagattacttcccttccggtacattccattacaagcattgatgttgtaccgattccaaaggatatgacaaccaaagttcttcagaagaaatatcttggtattgaatctgacattatcaagcagcagagggtaagaaacaagaacaatgatttttcttcggaaatttcctataacaagagaattgagaaaaaggaaattgaggagattatggacgatgtgcgtgagaatgaccagtgcttatattatgtggcagtaaccattattcttatggcagactccaaagaagaattagacagtatgaccgagactgtggaaacaatcggtaagagaaattccgtaaccattgaggagcattacctcaagcagagagaggcattaaatacagcactccctatcggcgtaagacaggtggaaaccatgcgtactatgctgacacagagccttgctgttttaatgccttttaatgtgcaggaaataaacgacggttgcggctgttattacggtatcaatcaggtatcgaagaatatcaatatcggaaaccgtaagaagctgattaacggtaacgggtttgtgtttggtgttccgggtagtggtaagtcacatttctgtaaaatggaattgggacaggtattcttaggtggggaagatgagattatcattatcgatccgatgaatgagtattttgacattgcacacacctatgggggaacggtagtaaatatgtccacctatacggacaactatgtgaaccctcttgatatggatgtctggagtcttgacttaaacgacagtaaaggcatgattcgtgaaaagggtgagtttatgctcggtctgtgtgagcaatgtatgggtgagagccttaactcccgtcagaagtcaatcattgacaggtgcgtgagaaagctctatatcgagattgcaagaagcagggagaaatatgtacctgttatgtcagacttctatgatattttgatgaaccagccggaggaggaagcaaaggacattgcactttctttagagctttttgtaaatggttctttaaatatcttcaatcatcagaccaatgtggatgtagataaccgttttacagtctacggaatccgtgacttgggtacggagcttagccctatcacaatgcttgtaatgatggagagtattcagaaccgtatcattgagaatggtaagagaggtatcgcaacatggctctatattgacgagttccatgtacttcttaattccgaatattctgcaaagtatttgcagcagctctggaaaaaagtgcgtaagcaagggggattatgtacaggtatcacgcagaatgtggtcgatcttttgcagaactatacagcaaccacaatgcttgcaaactctgagtttgtggctctcttaaagcaggcaaacacggacagctccaaaatggcagaggttatcggtgtatcagaggcacagttacgcttcgtaaccaatacccagagtggtatgggacttatgaagtgcggaaatgtggtaattccttttgacaataccattgagaagggtactgacctttacaacctctataacaccaatatccacgagaagattgcacagcagaaggctatggaacaggaatcttaaagtaaatgaattgcactcaggccgtttggcttgggtgcaattttcataatggaggcaggtgagagaagttgaacattaaaaaggtggatgacaagcctatggtcattcataccaaagaaaaggcgaagctgcatattaagcaggaaccggaggcgaaaatcaagggcagaaatgttttggtggttgataaaggtcctaaaattgcaggaatggataagaaagataagacggttattaaaaaatcttctgcaaaggaagctgtgaaaaattccatgcaaaaggaaaagggtatgtatgcacaggtgcaaaagccaaagcaggatagggaaaaggctatcggcaagaagaatagtacagccaaagcggtagcttctgcgggtgcgatgactgccttagaccagatggatggcggaaatgaagtctatgaatcttatcaggtggcaagaacactttcagctccggcggagagtgcggcagatgcaggcagaaggttataccgttcacaggtagctaaagcacaggcaaagaagattaagaaggtacagtcaggtaagaaaatcggtaaaaaggctgtcaaggatagtgccacgaaaactgcgaaatataccgctaagaaagtggcaaaggagactgcgaaagaaacagccaaagagacagcaaaaattgcagcgaaggaaacagccaaagctactgctaaggtagtgactaccacagccacaacaacagcaggtacagccatttctcccggagtgggtacagccattggtcttgcggctggtagtgttgcagggtatgcaacgggagtaaaaatggactataaggatatgcaggcaacgggcagggcaagaaaactgaaattctttctggataagatgaatgccgaagaacagcagaaagacagttttgcgaagctgataaaagacttggttgtgggtaaggtatccatgatgattaaggcggcggctccgattatcggtcttgtgttgttactgcttgtacttcttgtggcagtagtggcaattcctgtaatagcagttatagcggttctttataattctccgtttgccatattcctaccgtccatatcaacaggagatactacgcagaatgtactatcagcctatgtgtcggagtttaacggagatataacaacggagctgaatgatttggaaggctgtgacaggtcggaaaagatatatgtaaatttcggtggggaaggcataccggataactactgcgatattctggttgtatatatggttaagtatggcgatggagatactgcaacggatatgacggataaggcaaaagagaatctgaaatcggtctttgatgatatgtgcagttataccacttccacaggaacagagacagatacggatgcagaaggcaatgaaacagaggtgtccgtaaagtatgtaaatgttacgctgaaaacctatcaggatatgattttggagtatgggtttaatacggaagaacaggaaatgcttgcagagcttatgaaaccggagaatcttatgatgttggggtattccggcaacagcggaggacagaccataagccccgaacagtatcaggcaatcgtggatgccatatcagatgccaatggaaagaaggttgtggagtttgccttgtcaaaggtaggttatccgtacagtcaggagttaagacacagcggtacacactttgattgcagttccttagcttattatgcttggaaacacgcaggtgtggatattgaatatcttggttctacaacagcagcctatgaagggcagtattgctatgacaataactggcttgtgcattacgatgaaatgcaaccgggagatttgatattcttcagctacgagcagaatggagcatttatgaatatcagccatgtagcaatctatgtcggtgacggtatgcttgtggaggctgccaactcacgaatcggtgttgtgtatcgacaggtacattcacaggacagtattgtgatgatcggcagaccgagataggtggtgtagtaatggctaaaaaagaaaaggttgattatgaagcacagcttatcagggagtatgagcattgggaatatctcaaagagcatggtggcagcgatccgaattatgatgacggtgtcaatatgaacctgactcgcaaccatatcatttattataaaaatgagttggaagatttgtatggggaggatatgagtaaatatccggaagtgtattttcgtgaactgccaccggaggtagaaggacaatatattgcaagggcagatgaaattcgggataaagcagtagaagctcttgagatttacttagcagatgcaaattttcaatatggataggttacaattaactggacagattttttaaggtcatataatctataataaatacacgaaggagcactctttatgaccgaacaaaaacaacgacgaaaacctcgcaaatatgcgccttgaagtcccccggtgaaagctgctcccggctgcgccgttcttcctgtaagagcgattgcagcgcgtccgggtcgttgggtagggcttcaaagcgttcaaacttcccaagctgcgggtctgggttgccgttgaagaaccgtccggcgggtatctccctttctcctcgctcataaatcagcttcaccgtatcggcgggcagctccttttccttgacgcactcataatgtttagcgtagtccagttcgtacagattgcccttgattttcccgcgctcctttcccgtcagctcgattgcataggcaagaacgcggtcgcttgtctgctccatgtagaaacgccatgtattgtggggcgcggtgtctttgaggaaaacgtcgcgctcccggaaacagtgcgtcccggacgggcggcagaaccacaaaagggtcttgtcctccctgtgggggcttgccgccgcctttgcgataatctctttgtcaatgtctaagtcgctctggtaaaagcctgtgttctgcttcataatcgcttcaagggaagcgaacaaatccacgttttcaaatttactctgttccggcatgggtcagctcctttccaagtcctgtgacttctgctttgcgtttttcttctgcgccttttccttgtcggctctaagctgcgcccggatagagggcttcttttccggcttcgcccctttgccgcgctccttgtcggctttgacagcgttagccaggtcaacaagggaaatctgctcgcccgcctttacctttgcttccagttcgtcaacggtgggggtgttgttgatgataccgtcaatcatgttcccgttctgctctgtggtctgctcggcggttttcaagggattgtcccgctgcgcctgttctgcggcaacggcaaacgcccgcgtcccattccccataatcagatactttccgtcgtccgactggtggtgaaagccatatccggcggcttctatctgctcccggctcatggcggttacatggaaagtccctctcggtgttttgacagtttcgcccgtttccaagtcgtccggggtaagctgcttttgctcctgtaaaaactccggcacttcccggaaacctacactgtcaacgaaatgcgccgcgtcctgtccgtcctgatgaagcactaccacgtccgaaacggaaaggctgtgtcccttaaaatctttggggtggtcgatattgaaacgggtgtaaatatcttcaagggaagtttccggcgcaaggggcgcggaatagacaagctcatagttcgccctgtcaaccacattccccgccgcctgcaggcggtcgtaaggctcaaagcggaaatcccttgtttcgtccccgccttttatctggtaaatggaaaaggtgtctttgtcctgtccggcggtctgcgccgtttcctgtgcctttgcgtaaagctgtttcacgtcgccctcggtcagctcgccgcttttgagctgccccataagctcgcggcatttctccggcgttcccgtataaagcacgtcgcccattttcgcccgcccgttctcctgtgtcacataggcttgcaagaggtggctgttttcccggctgtcgctgtaagggttccggcgcactctgtaaatcgtttccggggtaaaggcttctttcggggctgcgcccgccttttcctgtgcgccggattttcccggtgcggctgcttccggcttctctttcccggctgtatctgcctttgccggggcttccggctgcggctgttctttcggggctgccttttcctctctggtgggctgctcctgtccggcggtctgctccttgtcctgtgccttttgcagctccgcaagattttcgtctattgaattgataatctcggcggctgcgctgcgtatcgtttcaagggagcttttcagctcggacagctcccgcccgctgctccacccggcgacgtagccgaaagagtagtccgacgtatcaagcccgtaatgttggcagacagtataggcgacgctttccgcttcgacttcgcgggtgcggcggtcaatgtggggttgctgctcgtcctttggcgcgttgaggtcaatgtcgtgcagcttcgcatgggcgatttcgtgaatggcggtctttaaggtctgtaattcgctcatgccctcgttgatagcaatgcgcttgtcctccaagtggtagtagccatgagagccgccctcgatattttcaaaggcgataggaacgggggaagtcttttcaagggctgcgaaaaaatccttgtagcggtcaacgtcgcctgtcagctcgtcaacggcaatgtccggcagctcctttccctcggtctgggaaacgtcaaagactgataccaccttgtaggcgggtatggtgacttccttttcctcggtgacgggcttcccgtccttgccgattatgggcttctgtgtgtgcgggtcgattttctgcatttcctgtttgattttatagggcgacggggcaatgattttaattcccttttgccctttcatcacgtttcgctcaaagttgttcttccaagcggaaaagcccgccacaagggaagcgtccggcttctgcatggcgataaggacggtgtttcggaagctgtaattatggaattttgacatgactttcagatattccttgtaacgttcgctgtcaaagagttccgcaataccctgttccagacggtcggtaatctcttttaatttctcggcgggcttctcgctcgtcagcacgatagggataaccgggcgcggctcctgtggctgctctgcggtctgtgcggttctctgtcccggcgcggctgcgtcaaaatctgctttttccgggtcggggcgtgaccgctgcgggggctgcggcgttacccggtattcctgtggcacgtcgcgcccgtcgtaccattctgtaaaggtgttgcggttgttgtagatatagcccttttcggtaaacataccgtcgtcgttaatggaagcgtcccgcccgtattcctcatacatgaaatactttttcgcttcttcgggaagctccggttcttccagttcgtcaaccagataacgcccgtattcttcttcactgtggacggacggataaagccagtagcagtcaaggttctgtgcaaggttgatgatgtcctgtaagctgtcggcatggtcgccgtattcaatggctgcaatgaatttctcccggtcgtcatcaaactgcatttccaagagcttccctaaatagttcagctcgtcggggtgggaatactcgcttaaatgttccgtcaagccggggataggggattgaaattctgtgaaatgccattcctcgtaatgcttgaagtcaatcccgatacggtcaaagacttctttcagatgttcggcagtcgtggggaacgtcacccattcgcccgcgggtctgccctcggtgtacttcccaagattggaaagatagccgcttaaaatcggttctgccatttgtctgctcctttcttcgttcatcatgcggtgcataagctcgtaatcttcgtagctctgtctaccgtcaaatacataggggtcaaaatcctctccgtcccggtagggcttttcggaaaagggaagccccgcttcatgggcggttgccctcgcttcctcgataacctccgggggaagcctgtcgtcatgcgccccgataaaaccgtcaatgtcgttcatgctgttttcgtagtggtagcgcactccggcggtcagctcgtcaaggctcatgtcctcgcctaaatgcccgcagtaatagccgtttaggataacggcggcggggtcggtgcttttgatttcctctaaccggctcctgtcctccgggtagagcgtaccgtccatatcaagatgaaaatattccgcgttccatgaacgcccctgtttccagaacgctacccacgcgataccgtccctaagctcgtcttgatagtcctttacggtgtcccgtaaacttgccataaatgaaaacctcctttctctgcgtcagcgtcataagctgtattttttggctgcatagcctactacggtacacccgcatttctgccaaagatttatgaaaattttcagagggtgaagccctccgcaaaaagagggtttgggaaacttcccaacaagcaaaatccccgtccggcgcgtcagcgacaggacagggatttacggaagtgggtacccgcttcctatgcttgctattcaagtttttagttcttctgcacttcgatacggtagttgacgtatttcccgccagtatcggctaaaacgatagttccgtcgtaggtcttgcctgttttcggggagtagagcttcttcacattcgccttgccggatttaaggagcgcggcggcaatcttcggggtaaaggcggtcttgcgttcctcgaaaaagcggtcattcttccacatggtaaagatacattccttattgctgcaataatagtttttcttcccctcatagacaggggaaccgcaccggggacatttgccgacagagggcttttcctcccggaacaagccctttttcccgtccagtgctgcggcgtgtgtctgcacaagctcccgcgtcatagcttcaatgccggacaaaaattcgccggggtctgcggctccctttgctatctgcgtcagattgttttcccattctgcggtaagctgcggggaagtgagcatatccggcaagactgatataagggcggctccgttctgcgtggggataagctgcttgcccttgcgctccgcaaagccgccctttaccagtttttcaatgacggcggcgcgggtggcgggagtgccaagcccccggcgttccgcgtccgggtcggtgtccccgttcccggctcgctccatagcagagagaagcgacgcttcactgtggggcttcggcggcgttgtggtatgctccgttacctttgcggcggggttttcaaagccctgtccctcggaaagctccggcagcgtcatgccctcattttctccgtcctccgggtcgggtttatctttcagcgtcgcccggtatctgtgttcaatctctttccacccgtcagaaagcaccgtctttccccgcgccgtaaactccgtatcagcgcatgagaaaaccgccgtaaccgcttcaaagatatgcggctcggcggtggcaaagagcagacgcgccccggcaagggtgaggatatttctctcgctttccggcagcgcgtccgggtcagcttttgcaagctccatagtgggaatgattgcatggtggtctgatacttttttactgtctgatacctttgcaatatccggcgtgaagcccaagccctccataaaggaaaatttctcacaaagcagcttgataatgcccgctgcggtgtcgcccatgtcgtcggtcagaaatgcgctgtccgttctcggataagtcaagagccgcttttcataaagggcttgtgcaaggtcaagggtctgcttcgcggtgtagccgaaaatgcggttcgcttcccgctgcaaagaggtaaggtcaaagagcttcggcggggctgcgctctttctctctctggtgacggaaacgcataccgcctttcccgcttcgcaagcccctttcagcgcgtcggcttctgccttgtctgaaatcctcccgcttgccgcttccgcgccggacaaatcaaggcgcacatggtagtatttttctttctggaaatgggagatagccgcgtcccggtcggtgagcattttcaaggtcggtgtctggacgcgccccacgttcaaggtctttccatacaggcatgagaaaagccgggtggcgttaatgccgataagccagtcagcctttgcgcggcagagcgcgtcatattcccgcccgtctttgagggaagcaaagcccgccttgatagcttcgtcctccattgaggaaatccacaagcggcgcatgggcttcttgcagcccgccacttcgtagacaaagcggaaaatcagttccccctcgcgccccgcgtcgcaagcgttcaccacttcagaaacgtcggcgcggtgcataagctcctttaaggtcgcaaactgctttcccttgtccgggtcaacggcgtactgccattcctccggcagaatgggtaggctgtcaagctgccatttcctgtactgctccccgtaggcggcagcttccgcaagctgtaccaaatgcccgacgcaccatgaaatgaggtagccgccgccctcgatatacccgtcctgtttccctttaacgccaagcgcggcggcgatagtctgcgccacgctcggcttttctgcaatcacaagtctaagtgccatgaaaaaatcctcctttcagcgttccggctcgcttgcctttttcttctgtacctgtttcagatagtagcccacacaagggagctgccctttgtacgggcaggaagcgcaagccggggaatggggaacgggcggcgcattgtcacgccgcccgcccggtctttgtatcatcatcttttcaaagggattgtcggtaaacagggtcatgcttcctcgtcctcctgttcttcatcagaaagcccgtccccctcgtccggctccggctcgtcctcgtcgtagtcgtcaaaatcgaaatcttcaaggtcggtgtcgcccttgacgttctgcttgcgtctaataaacttaaaataatagaacgcgcccccaccgccaagaagtgccacgacaaggaaaagcacaagcccgcccgcattgcctttttctttgggctgctccggcggttcttcggtttccggctccacttccttgccgctgcaagcggtcatgttgtccttgcagacggggcagctcacatttactttcccggctttgcatttatcggtacaactgcaaacggtgggcggggctgcttcggtgcttccgtcctccataagtgctaagaggtcggcttcgtctacttgattaaggaaatgtacagtattctcgccctcgtcgtcccggtcaatgaggatataaaagtaattgccgtttttggtcgtcactgtgataagctgcttgttgccgccgaaatcgtctacaagggtcgcgttcccgtccggggtaaggggttcttccttttggggttcctcgtagacaacgccgctgtcgtcagtagcgtcctcgccctccggggtctgtgcaaaggcggtgacggaaaagccgcccgtcagcataagggcggcgcaaagtgcggtcaaggttctaaggattttcttattcattctcggtgtcctccatttcttcgttgtcatggtctgcgggttctgcggggtagcccggcgcggcttccatgcccggaataccgcccccggaaagcatagcggaaagctcatgcggggaaaggcgcatggagcgcacaagatgtacgatttgcaggttttccgcttcggttttctgcgcttcaagcccccttaatttattctggtactcggtgattttctcgcgggtctttgcaatctccttgtcgatacgttcaattttgttcatagccataaatcaatttctcctttcagattttcagtgttatgtttgtttttagttccagttcatcagcccgtagcccttgatacagccataattgacggggtagctctttatcttgcaggcgtcgccggaattgccctcgacggtatagacgcgctccccgtccgtcccgataacaagccctacatggtctgcgctcccgtccccgtcccagtcgaaaaagatagcgtcgccgggggcgatattctcatagcccctcgcgccccattgcccgcgtgactggaaccagggtacgccctgtgactggcacccggcaaagcgcggctcgcttttcccggcttgattgtagcaccatgaaacaaaacaggcgcaccattccacgcggctgttaaatccgtaccagctccaaaagggtcgcccgcccacgttgccgacttgccgcttcgcaaggtctacaacggcggtgttgccggggcgtgtgccgtttacaagctgtacgccgcttaaatcctcggacgcgcccatatcgggggagccgccgccgaaaatcagcggtttgttgccgcttgtttccagatagacgcggtacatttcaagctgctccggcgttagaagttcctccgcaatctcggaaatgggcttgtttgtcagcttcacgttaaggatatggtactcgtagggtacttcctcggtggtcgtttccccggtttccgggtctgtgcttgtttctgtgcggtagcggatttccgtttcttccgtcagcgtcaaggtgtactgcatggcaaagacgcggtttaattctgcctgtgcgctctgcggggtgtaggtctgtaaaagtgcggtgaggtaggacgctaactcatgggggttatgcccgatactgtcaaggtcatagcggtattcatcatagccggggtgggtgctttcgatattgtcaatctgctgctgaagctcggcttcctttgcggcgtaattattttccgtcgccacaaggtcgctgtcctccgacgtgtaggaagtcccaagtatgccgttcatcaagccggagaacatggagccgcaagaggaaagccccgccgataccatgatgaataagagcagcgcggcaacggcgatacatacgcccgccgggtgccgccctacaaaagcgattgccttttttgtttcctcggcggtcttttttgccgccttgcgggtgttctctgcggctttctgcgccgtttttgcgccgcctttccttgccgcctttgcatactgccgcttgatttgctgcttctgcatgaagcgggaaaggggattgcccgcaatctgcggattgtcatgcagggctttgtggtactggaaatccacattcgccttgaacgccgctttctctgcctttgccgccgcccggtagggtttgagcttgtggctgcggtagccctccttgactttccgcgccccgtactttgcgccgcgctctgccagttcttcggatttgtgcgccccctcaacgccggaattgtccttttcaacggaatgtatcttgttgtggacgaaaatacccgcttcctgtgcggggcgggatagcgggttattgtggggcttattttttcctatgggcttttcccgttcctcaaagcgtaggcgggtcttgcctttcccggtggcttcatcaaaggtgcgctcccgtacaagtttcttttctttggggatagccgcctttgccgcgtccagacggtcggctgctttgtccgattttcggatatacctttcaagctccggcgttgcccgttcctcgtcggtaaactgcaaacgggaagatttttcttttgctgtggcttctgcctgtgctttcctcgccgcctttttgctcgcctttctggtacgcgccccgtcgatacgttccaagacgcgctcggctgcggcggtgtcctgttcccgttctgcccccggcgcatggggaagcggcggcgtgtcggctgcgggcgcggaagcagcgccgcccggtatggtctgcgctgcctgtcccggctgctgcggggcggcttcctttctggtaaggtcagcgtcccttatgcggttgctgatacgcttttttctgcctgtggcggcgtttacctcaacggctccctcgcgggtcattttctgcgtgactttctcacgcgctttatactgttttatttgtctgtccctccaatccgcgccctcgcaagggcgcaatactcggcgtttatctcaatgcctatataatgcctgtcaagctgccttgcggctgcccccgtcgtgccgctgccgaaaaaggggtcaagcacaacgccgcctttcggacagcccgccttgatacaggtttcggcaagttttggcgggaacgcggcgaaatgcccgcccttgtagggaacggtattgataagccacacgtcccgcctgttccgcatggtcggcatgagggcttcgtcgtagtagctgccgcttcgcgcccggttaagcccctgtactttcccctgtccgggtatttcgtccgcatatttctgtcccgcgctgcgcccggtgcggtaccgcgccgccgttgtgggggctaacggctcggctatggcggctgcgtcatagaaatatttctttgacttcgtaagcagaaagatatgttcatagcagcgggtagggcggtctttcacgctctccggcatggggttttctttctgccagataatgtcgctccgtaaataccacccgtcagcgcgtagggcaaaggctaaaagccagggaataccgattaagtccttttgtttgcagccggaaacgcggttgtttcttgcaatctgctgtccgtttctgcctttcgggttcttcgggtctgcatggtagcctttatttcctgtgccgcagtaagtgtccgcgatattcagccagagcgtaccgtcagaacgcagtacccggcgcagctcgcggaaaacctcggtcagcctgtcaatgtactgctccggcgtgtcctcccgcccaatctgcatatcaagcccataatctctaagcgcatagtagggcgggcttgtgacgcaacagtgtacgctttcctctggaagctcccgcaaggcatagagcgcgtcgcggttgatgatggtgtcagttttcagcccgttcatgcttcgcctacttcctccggcttcgtcgtcattacccggtaaagctcggtgtctttcgggaagcggtctacaaagggcagcaccacgttcccgtagaagataagcccctcgcccgcttcggtgtgggtgacatatttcatctgctgcggggagatgttgagctgctttgcaaggatagcccggtcgcccgccgcctgattgagcatgaggacaaaatcagagttttcaaagatattctccacttcgcgggaagcaagcaaatccttgacgttctgcgtaatggctgtgggtatgccgccccattttctgaaacgcttccagatttcaacggaataggcggcggtctgttcctctttcaagagaagatgaaattcgtccataaaataccgggtggatttcctttctgcccggttgacggtgacgcggttccatacctggtcctgcacaatgagcatacctaactttttgagctgcttcccaagctgcttgatgtcaaagcagacaaggcggttgttcagctccacgttggtacggtggttgaatacgttaaggctcccggaaacgtaaagctccaatgccgccgcgatacgcgccgcttccggctccggctgcttcaaaagctcgtcgtagaggtcgcccaaaatcggcattttctccgggtcggggtctgcaaggaaagggcggtacacgttcttaacggcgcggtcaatgacggtcttatcgacgggctgcaagccctccttgccgcctatgacaagctcgcagagggagaggataaagtcggatttcagcgcaagggggctgtcgtcctcgctgtaattgaggttaatatccatagggttcacatactggggcttcccgtcaatgcccttgcccgtaggcgataaccgtatcacttgcccgtcaagccgctgcacaagggaaaaatactctgcttccgggtcgcagataattatgtcgtcgtcggtaattaggaaagcgtttgtcatttcccgtttggctgcaaaggatttcccgcttcccggcgtacccaagattaagccgttggggttctttagctgcttgcggtcgcagagtatcatgttgttagacagggcgtttaagccgtaatacaaagccgcgcccgtctgaaaaagctcctgcgtgataaaggggataaagatagcggtgcttgacgtggtaagccctctttgaatggggataaggttctccccaagcggtacagaggacataagccccgcttcctgttggtagtcaaggcgggttaaggcgcagttgttcttctgtgcaatgcccgccgccgcgaatacgtcattttccagtttcctttttgtgtctgccatgttcaccacaaggaacgtcaagaggaacattctttcattccggctctgcaagtcctgtaagagatttttcgcttcgctgccaaacgtggcaaggtcggacgggataatatccatgtcatagccgctgcgtaccgctttcttttgttcctcgattttcattttgtcaaggtcggtgattttccgcttgattgtctttatggcttcggtctggtcgatactgtggatatgcagattgacgataacgcccgtttccaagtccagaatgtcggataagatacggtcgtttaattccggcgcaaggatttcaaggaatgaaaccgcgccgattttgcgccccatgcggaaataccgcccctcgccaaaacggaaagaggacggggcgataaagtcctttgtggaaagcccggacggggcaagccatgaaaaatcaaaggcaaactgcccgccctccgggtggaaaatgccatgcagcattttaaggcgttcatagcctgtcatggggcgggcagacacgcccaagagcttaaagttgttcagcacgtccgtttcgatacgggcaaggcgggatttcgccgcgcccagactgtcggcttcaatggcaaaggtgatatattttgctttgacaagcccgttgtttccctttgcaagctggtttttcagcatatcccggtattctgtgcggatagagttgaaagcgtcctcctgtgccgggatattgaccgccttttccgcttcgccccgctgcgtcccctgattgatgaaagagagctgcaccgaaacggaagcgtcaaagtagttgaggaagtcgcaccagttctcaaaaatggcggtcttgtcgtctgcctgtgcaagctgatagttaatatcttcaaaggcgacggtctttgagtatttccgtcccgtaaccttgcagataccgtccgggtacatctggatataggggattgtctgctgcgcggtgtgggctttcccgtcgccctttgcctgtctgatgatttccgcaatctgctttttctcggcgcgggtgagcttgcggggcgggttaggctttgtgcttcccgccgcgctgtttcttcgtgtttccttttgcaatcgctgatacctccttttcaagttttctctgccgttctaagacggaataaaagttgtctgtcctgtatggtcgttctttgggggctatgaattttgtccgtatgatgttcttcaccaccacttcaaggggctgtccatgcttctcatacatggcaaagaggaaacagggcagcatgacggcaatcatagccatagacgcaaggcttgtgcctgtgctgtctttgagcagaaagaaaagcggcaagccgaacaggagagccgccgcaaaacatacaatctgccgtttggtaaggttgaacgctacttttgtcttgactttggataagtctttgggtacgggtacatacgccaagtgaaaacctcctttctctgggtttggtgttgctgtaattttccataagggtaatcaaggcaaaggtcaatctatgccctttgcccgcccgtattatatgggggttatccgcgtcaaggtcgggtcgtattttcgccgctccgctctgaaaatctccaccctgcccttgacacgccgctaatgcgcggaaaaaatcgacttcgccagtgcgccggatttgaacagggagaaacagaggataacggtataggctgcaagggagaatatcgcactgtgcagattgtccgctattatcatgttgtttaccagaaccgcgtaaatgccgacgcatatcataatgaggaagccttgaaaaccgatagcgaacagggattttaggtagttgtttcctatctgcccccattcccggttagtcatagttgcaaacgggataggcgataccgaacagtaaaggtaaatttctatcatgcgcccgtagaggataacggttatcagtacggacatgattttcatgcacaagctcacaaggcttgtttccatgacaagtaagagcagttcggggatttccatagcgtcaagcccgctctgcatggaagcaagggcggcggcaacatcaatctctgtgctgccgccgattacccccgccgcgccggaaacaacgtgctgcgccatatcgaacaccgccatagtgatgtcaaaggtgtgcgtcacaaggtagactgccacaaacgccttgaacacccacttgaagaacatggaagtgtcaacgtcgtgcatattgttcttttccgttaccatgctgataagctcatagcataggacgtaggtaatgacaagccccgcaatgggtacgattacattctcactaagggtctgtatcatggagaatatatttgcgttccacccttgcggggtctgccctacctctgcggcgatagtgccgactttttcgtttacgtccccgaacatagttgacagattaccgtttatggctcctatgaggatttcctttatccattcgttaatcgcgtcaagtatgctctgcataagcctttacccgcgcttcttaaccgaacaagccggaaagcagcggtacaagggtcatgccgataagggcaacgccgccgcccgccataagctgttttatccccaattaggtgtaaaactctgctcgatggcgggcggcggcgtacaaaaaatctatatggtgtttttaagagaaccgtcccggcgggacaggtcaggcagtgacctgttccacctccgggatgggtttgagattaaaatgaatttcgatagaaatgtgtcttgttttatcttcgtcaatgcgctcatgcacgacgatttctttgattaagcggttgagggtggctgcgtccagttctgtaatgttggcgtattcctgaatggcttccacccattgttttgcgtcattggcaagctggacttcatcggacagccgctttctgccctcggacacttttgttttaagttccgtctgctcggtctgtgtcttttccagcatggtgttgaagttctgctcactgatacgccctgcaatcatatcttcataaagccgcattaccattttgtccagaacctcaatccgttcctcgtcccttgtaagggagcgttccattgcttcccgctgttcccgctgctcggcttcacaggtattggtcaggcggtcagcaaccgctttcccgtccatcagggcagctctggcacattcccggattttccgcagcacatgactgtaaagggtgtcataatcaatccggtgctgggtgcagtggttctttccaaaggcattgtaggtcttgcaggagtaaatctgctggggatgttttgcgtttgtgtagcgtaccgtcagagacttcccacactcgccgcattttatcagtccggcaaacaggctgatttcattggtctgccccggacgctggcgggatttcagcttgttctgcacaatgtcaaagctcatgcggtcaatcagcggttcatgctgtccttccactacaatccagtcctccggcttcttttccccaatcgtgccgattttgaaacggtagtcctttttctgggaagcaatcgccccagtgtaaacgggattcatcaaaaggtctttgataacggaaaagtcccacatataccgcccgttttccgggtctttcttttcccatttggtgcgggtattgcgaagcccccgttcccggttccaccatgtggggcaggggattttttcttcctccagccgtctgcggatatagttcggaccatgaccgtttagggcatatccgaaaatcagccgcacaatcggggcggtttcctcgtcaatgagcagatggtttttgtcctccgggtctttccgatacccaaacggggcaagacacccggtaaactgtcctttctgcgctttcagaagataagaggaatggactttcttggaaatatccttgctgtacatctcgttcaggatattcttgaacggggcgatgtcgttgttatcccgcagggtgtcgataccgtcattcatggcgatatagcggacaccgtttcttgggaaaaagtcctcaatcaaatgccctgtttgcaaatagttacgccccagtcggctgaggtctttcgtgatgacaaggttgatttgcctgcgctcaatggctctcaacattctctgtaaatcaggacgctccatattaagacctgtgaagccatcgtcctgatagactgccacaacctcccatccctgcttttcgcagtatttttccagcatatcacgctggtttgcgatactggcactttcgccttgcaggtcatcgtcctttgacagcctgcaatagaccgccgcacgatagcccccggcaagtgctgaaccgattgttttgtattccatttcgttcatcatagccatttacccacacaatccagacggtatctggctctgttgaacctcatcttcattatacttcaaatctttctttttagcaagatattcttttgtatttgttttgccgtatttctgggaaatcaggctgacgaacacatcggtggcgtccagttccccgtcaaatacggttgtcacttcaatcttggtcttatttttcgccataggcagttatcctccatacatgaaaatagccagacagagaacggtcggcaacgaagtccggcaacgggcttcaaaagaccttgcaaacaatctcaatctggcgttgattactatttatacttttcttttatttttctgttgttttggttgtcagagagggaaaaagcccggaaataagggattttccccggcaaccggctcggcaacgggatagcaacgaagtcggcaacgggctgtcattttcagaatggaagctccatctgctctgtgacctccacaaaaccgtccatagatttttcgggcgggttgtcggtgtccgttgccgggatttcacgctcccagcccttttgtctgccgtattccgcaaacatcctcggattggaaaagtagttccacccggtaatgcactggttcattatctcgttgatttcccggatttcccattgcttcggctcatcaaaggtgtggtttaaggcttccttgtagagctgcttggagcagaccgtttccccggtgtacttatcaaggtaagcctgtatcatcccggctttggtgtcctccggcataaaatcccgctggtgttctttgagataccgctgcatggctgggctgaatgacagcttgaacatgccgcttcggtaaatctccattgcttccgcccacatctggctgatataggctctggaagcggcttcgtcctccaaaatgtgaacctcggcttgctccgggtacaccatgaccgggataaatcggcggttgccggaacggtcaagggggagaaagtcaagggcgttggaagtgccgccgaacacgcattgacgggggcggtctgccgggtgagtttcatagggaattttgtaaacctctttctggcggcttagaaaggacttgatttcctcaatgctcttggcattggcggttgccatcatttccgacatttcaattatccagtgaccttgcagcttgcggtacacgttatcatcgtccagcttccgcaaatcatcggaaaaccactcgtcccggactgccagcagccggaagaaggtggatttgccagccccctgaccgcctaccagacacagcatgatttcaaacttgcttccgggcttaaatgcccttgtaatcgcccccagcatgaacagcttcaaggcttcataggtgtaatcgtccacatcagctcccagaaagtgccgcagacagaagcggatgcgctcagtcccgtcccatgcaaggctgttcagaaaatcccggatggggtggtacttattctcattcgccacaatcccgatggcggtttcaatctttttctcactggtaagcccgtaggtttcctccagatagagaagcagatacttcatgtccgtatcggtcagggctgtgctttctctgtgaaaaccgatgggctttatgatgtccttgcggtcggtcaggatgttgtaggcgattgccccggcaagcacagggtcacgctggaatacggtcaggcagttccgtatgctctggcggacgccgcctttctcggtggtttccagagttgcctttacttcctcaacgctctggggcggctgcatggcgttcatggtgttttttagttcttgctgcgtctgcggctgcaagctctgccattcgctgttcaagctgtatcacatcctttccgtagtccataatcaaaaccgctttttcctctgtctccccgaacagcagcacatccagcagatattccacatgggcttgcttctgcaaggcttccacgaaccggggatgaaacgcttcctccggggagtgcggggcatagtcggttttccatacccgtaagaggtgtagataatcggcaaggacacggaagcaatgtgcctttgcttcccggaactgttcttccggggatttctgccggggcttgggcttccttgccctgcccggtggcttccagtcctcataggcaagcccgaagtcactcgccaactgtgcggcggcttcctttttccccagcccgtacagggcagctacaaaatcaatcacatccccatctgcaccacatccgaagcagtggaaacgcttgtccagcttcatgctgggggtcttatcgttgtggaacgggcagcaagccatcccgtttctgtttacccggattccgtaatgctccgcagcctgtcttgtcgtaacggactgcttcacagcttcaaatacattcaaatcaattcctccttgtaaaaaagaaaaggcacttatcattctcaatctgaaaatggcaagtgcctgttaaagttccatatcctgttgtttgtgtttcgtctgcgccggggcgtttttctgtgctttcttctcgtcagccttatcctgcaagacttctttgaggggctgcttcttgggcggctctttgctttcctctgtgccgggtgtggctttccgtacccagtagcggatgtcccgcagcttcttcaaatcttcctgcacctcggtcaacggtactttcaagtctgcgatttcgcccacaagcttcgcctgttcctgcaaaagctcctttttcgtgctgtccttatcatccgggtgcttggcaaggtaggcactggctttctcaaaccgggcaacctccgggtgttccagcttgaatttttccttagttttcttgaaaaatatcttctggtatttctcataaacgggcttacattccttacagtccgtccgggcggcaaggatagcgtcaatcacgttgctgcgggtttcctttggcttcatctgctttcggtagtcggcggcagatttcccggacgtttctataaagttttccaaatcctccacggtggaaagtccctttctctgaagataggacagggcttcgctgactgcctttaagtctttggaagttccacggttttgtcccgcccgtgtccagtcgctccgttctgcctttcgtacctccatgtacttcatcaacagattgggaagaaataccgcttcctccgcagctttttccgcaagcagttcttttcgtttttcactaagctcgataatccagcctttgagatttttaataagctgccggatagacttcatcaggctgttggcggctttgatttcccggttcagatttccgatgttggtctgaatccctcgcttttccatctgccggacagcagcaccctcatggacggtagggataatatcaagcccctgtctttcataagaacggagatccacccgctccgggcggttgttggcttccagatagcggttctggatgatctcccattcatgccgccagatttcacaatacttgcggtcgttccagtcaaccgtatcttccttgtgacttttccatctgccggacggaagttttatccgttccccgttctcgtcaaggtcataaaccttgcggctcttgggaagccatttcccatgttcatccattgcccgcatagtcagcatgacatgagcgtgagggtttccgtcccctttgtcatggatggcaaaatccacgcacattcctttggaaacaaactgctgattgcagaaatcccggacaagggcggcgtactggtcgggcggtatctctctgggaatggaaagcacccaccgccttgcaagctgggagttccattgcttctcaacagcttcggcggcgttccataaggtattgcggtctgcatactctggcggggcatttgccgggagcaggatttcattatggacgataccacgcttttctgggtagtgcttcacttgctggtcgtattcacagaacagcttttcgccgctttggtaagcagcggcggcaacagcagactggcggttgctacgctggacgatggagatttgattgtgtggacagggcatttagtgttcctcctttccgattttaggtataaaaaaagcaggagacctttttcagatttcctgcttggtgtgccgctgggggcggcgggtatttagttaaaattcaagattacttaactttataatagttttctattgcctgtgcaaagaaatcagaagccccttcaccgtatttttcgtctatcattggtttgatttgttcattgcggtaatactgcgtctgtgccatcataaagcctttttcttcttttatctgggcaagctgtttcataacaaagccatattctccaacaagctcttttacttcaaaagaatctatgtcacaattctgttttgcaatcagtttttgcaaaatcgcttctatccgtttgttatagctttctgcaacttctttgctgacgggagttcgggcaacagacagaaacttgtcctttccaccataccattcaactacctttgcatagcctttctgcatttcttccgaagatacgacttccatataatgctttttccattgttcaatgctaccaaattctttaattgcaatgtttctcatattctccggcatatgctcaagcatggtttggaacatttcttctacttctgttttggtaaaaattgtaaaatccattttgttctctcctttcagaatgtcatcaatgctggcaatcagacgttccattcgttctttctttgttaccaacatttttcgctgtacttgtagaatctgatttctttcaagagccggattgtccaaaacagctttgatttctttcaaggagatatcaaactcacggaaaaataaaatctgttgtaatgtttccagtgccttatcgtcataaagccggtatcccgcatcacttttttctgttggctttaacaacccgatttcatcataatagtgaagcgtgcgaacgctgatacctgttaaatctgatatttcttttactgtcctcatagctgctgacctcctgttcctgataaggtaactttaatctatgacgttccgtgagagtcaataggcattttcattttttagtataacatttttcatttcttctcaaaagacagaaaactgattctgtaaaacttgtcggctgggaacagcttgcaacgcaaggtgtccccagatggcaagtccacaaaagggtagctggcgaaagccagcgcaggggaagtgtagcgtcccctgtttgatttggagcagtccgtggctgcggaaaatcacagccctccggcgaggagccttcggagaacgcaatgcaccaacctttgggtggtgtataattgcgcccttagtaaactaaggggtttccagcttctcccgttccagcagttttttcaatagttcctgcgtgtcctgcctgtgaaaaatgagtttcaacagcagcatgacatcatcatctgtcaggcgttccggctcttgcagaaaactttccagcataccgccacgagtacagagccgatgcgtccgttcctttcgggtaagctgcttcaactggtgctgcaatgccttttcatcattgatggctttccgcagtttcttttcgcttttttccaactcccggttgagcttttccagttttgaggtatcaggcaagggcagcgtcctcctttcccggtatcagcacataaatcctgtttggttctccaatgccctgacgcacccgcatgataagtccggcggtttccagttcattcagagaacgcttgaccgtcatggggctgcgggacaggactgcggcaatggctgtgatggggaagcagacaaacaggattccgttctcgtcctccttccctttggatagcatagcgtccagcatccggcagtacatgacctttgcggtgctgctgactggaaatcctgtcaacgctctgggaaatggcatacagggcggtaatggtgtgtctatcgtcataaattcaaaattcattcggtgtgttcctcctttttctttgctcgtttggataaataacaggggcagtcaatcacaaccgcccggaagctctgcttgcacccatgctggcatttccggcataattcgttgtaagtgacacgcccccggtcattgaggtaaaaggaaagctcatgcttcctctttttgctcattctcggcatattgtgtttcctcccgttttagtgtatggtctcggggcgattttcggcaaaattacagccatagagccgcttaaaatctcccgaagtatcagcgatagggtagactatccccctatcagattgtcgtgtttcggtatcatttcggtgtcagttcgccagttctccccggtgtcgttcctcccctgaatctcacagcggcgtatcgctccctttggtacgctcgtttcggtcagggttcctccatatccctgccaaaattcatggcgctacatcgccggggaagcatatcccacacaggctggtcattcgattggaataatccatcgatgaactacctgtatcatagaacatttttgtgccctgtgccgtatgtccacaaagtaggaattaagggtaaaaatcagaaatttccacgattacggaaagtgtgatataatccagataagcggcagcaatgaaaccgttggaaaggagcgtgtgcccatgaaaggagcaacaagcatacaggaacgcctttgggaactccgcaaggacaaaggcttaaatctggaagaactatcaaaactaacgggtatttctaaatcagcccttggcagttatgaaaaagaagattttaaggaaatcaatcatggcaaccttatcacgctggcagacttctatggggtttccgtcgattatctgctgtgccggacagagaacagggagcagatcaacacgccactgacggagctgcatttgaacgatgaaatggttgcacttctgaaaagcggacggatcaacaaccgtctgctctgcgaacttgccacccataaggactttatcaagtttcttgcggacattgagatttatgtggatgggattgccaccatgcagattcaaaacctcaacacccttgtcgatactgtccggcatgaaatcatagaacggtatcgccctggcgaagatgacccacatttgaaagtgctgcaagccgcccatatcagtgatgatgaatatttcagccacatggttctggatgacctaaacctgattatccgggatattcgggaaacccataaaaaggatagtgagagtgcgccccagaccactgttgccaatgaactgaaagaaaatctggaagcggtcgaaaatttcaagggcagccgtttggaaaaactggcagtgctttactgcaagcagctcggtatcaactataaaaatctgtcagatgaagaatttcgctggcttattcggattctccaaaaatcaaagaaaacgggaacgcctatcaaccagaggaaaaaacggtaaaggaaaaccgctgttgcatggtttgttggattccatgtagcagcggtttgtgctgtggttattacttcattcgttttcttaatattcggcgataatttgtttctccctttggtgcgtcctgtataatttccaacacaccatcttcaagcattttatcaatgcgattggaaatccatacatcactaattccaagttgatattttcctaaaacattacctatgacaatagccattttgaattgctctggctgttccgcaatttcacgaagaatgaaactatcatatatatcttctgaaacgctttgcaatttaccatttaacattgcacgcaaaggtgcattttcattttgaagttgattccatttcatagcacaagctgaaagaaatacaggattagctttctcttgtagagttatatagtttccccattcgccaggagagacctcgccccatgctattttggatgtcatagtattttcttttccatattcccatgtaggtaacttaaccaaataaattgttgtctggcagtttaagggttgaagttgtttcataagccaatacataccacaaagctcatctggattatagctataccaaatgcgaatttcttccccagctacatatcgttcaatcactgaggtcaatgtagttttaattttctgtattttttcttcaacctgataatctaaatcctctacaaagcagacagacagcattttcttgaaaacatttttccgctgttcgccaattccattatcagaaatatctcccacactaagagccatatcaaaacaataaacatcacagctcttgcctcccaatggaatagcattctcccaagcaatgcgttcttgttcctgtgcttgaagctgtgcttttttcatttcatctgaagatggaacactcccgtcttcatgcctcataaatattgaaacagcacttcctctatactttcccttgccgtaagtttgggcaattttcaaacttccacaggcactttcaccaaatacaatttcaatcatcttatatacctccgatttaattgctcccgttatgaataaatcatctcatgcaaaacaatttcttctgcccggttatgaatgttattgcaacgctgcacccattccatttggtgggtacgcttcaattcctcggttacgccctcggcagttttcatctgctccatgatggtgtctaaccgttcctgtgcctgttcgttcaggtctgcaagatatgtccacaattccccggtcagtatcaatgtattcaatctggctgggtggacttcccttaaatattcccggtgcatccgtccgtactttccgatagggcggtgttcctccggcagtttcaagtccgggatgtaataatctccgacaaggatataatcaattccgttttccgttattcttggtttcaattcgctcatgttccttacctcctgtggaagcaggctcgtctggtactaactcaatcacatcggtaatctcacaattcagcgtttcgcagatacgggctaatgtatccatgctgatgtgctttccctctttgctcatgttggcaatcatatttgttgtcataccagcggcaagccttaaatcctcttttctcatatcacgctctaacagtgtgtgccagagtggtttatagctgatgtgcatattgttttcctgcctttctatccataccaccggggcggctgccccggcaggaacttttctcttattatagcaccaatcttgtgaaatcacaatttattcttgtagcctgccgctgataccgtctggattgtgctcttcctttcgttttttgttccaactaattagccatgaactgtttcatgccctggctttttgcttatgtgtgataaagaagtaatagaagtgtaaaaaattttgccgttcctatccggcacttgcgcagggtgtcggataggtcgggctttattcttcgggcaagtcaatcttgcctacaaagctgtaataaatatcaatgcgctggcggcgtacttcgttctcgtcatactcacattcataaacaacgattttctccaccatttcacgcaaaagagtgtgtgtcagttcttcgatagaaaggtacttgcgtacaacgctcataaacttttcagcgtttaccgtggcttcctgtgccttgtccagctcgccctgcaaagcggcggctctgtctttcagttcccgctgctcggcttcgtagtctgcggacatttccatgaaacgctcatcactgattttcccgtttacattgtcctcatacagacgcttgatgtagcgggaaagttctgcaatgcggctctgcacctgttcaagctgcttggctgccgccgccagcttccgcttgccgcccatttcattctgctggataagcagcttcacgaaccgggcttcgtgcttctgtgcataggcggtcactttccgcagattgtccagcacacccgccgtcaaaaggtcggtgcgaatgaagtgcgccgtacagtcggcggtgcgcttcttatagctgccgcagatgtagcaatcctgctttctcttgtcggtctgataccgctgctggtacatcacatgaccgcagtcggcgcagaacagcaagccggagaacaagcccacatcatcgtagcggttggggcgtttgcgctgcttgcgtaactcctgcacccgttcccatgtctgcaagtcgatgattggctcatggtggttctcgaaaatcgcctgtttctcaatgggattgtctatgctgtgcttcatcttgtaggacggtttttccgtcttgaagttcacaagacagcctgtgtactcccggttttccagaagatgaacaacagtattggtcgcccacttacattcatagccggggtggtagcggcgtgtgctgcctgtgcgctggtattccagcgtccccggcgtggggatttgctgctcggtcagcatacgggctatcttggtaggcccgtttccggcaaggcaaagttggtaaatctgcttgactaccggggcggcttcctcgtcaatgatgaaattctcgtcatcgtccatgaggtagccgtacacgggcttgctggtaacaggctttccgcttagaccttttgctttcttaactgccttgatttttttgctcgtatctctcaccatccattcgttgaaaagattacgcagcggggtaaaatcgttgtcgcccattgcgctgtccactccgtcattgatagcgataaagcggacgcctttctgtgggaaaagcatttctgtgtacattcccacttggagataatttcgccctaaacgtgacatatccttgactatgactgtgccgacttttccggcttcaatgtctgcaagcatggcttgaaacccgggtctttggaagttcgcaccactataaccatcgtccgtgtaccagcagagattggtaaagccgttctgcttggcgtaggtttctaaaatgcgcttttggttggatatagagttgctctccccctgcaattcatcttcatgggataatctcggataaagggcggtaataaggttttgggttgtctgtcttaacatggtttcctccgtttctgacagccagccccactattccgtacttcgattgtaccacatggcggggcggcgtgtatagcggcaaaatgtgaaaaatgcttctttaccgcccgtcatattgccgatttttgtgtagcagcttccgcttccagcaccttagccattttgtcggctgcggtttccgtggcactctgcttgaaaaagccggacaccacaagaacagagttccctatgcggatttccgtcacgcagtcggcgggtgcggtgcttttcatgctgtgtttgatatgctcttttttatcggtcataggcaaactcctttcaatcgttcatcagctttttcagccgttccattttctcctgtgccttttccctgcggaaattcacgccggagcagcagacaggggtacacatctctgttacccggtcataaatccgcttgtgggctgtgtccgggggattgttcagctcgtcaaggcttagattggtcgtgacgatcagcggcttttcgcttcggtaacgactgtcaatcacattgtagacctgctctaagccgtactctgttccacgctccattccaaaatcatcaagaataagcagcggatagcggcgagcttggaaatatattcgttcctgccctcaaaggtggcggcaaggtcattgaggacagcggcgaagttcgtcatttttacggagatttcctgctccatgagggcgtttgcaatgcacccggcaaggtagcttttgcctgtgccgacgctgccccagagcagatagccgatgttcccggctttcatgtcctcccaatgctccacatagaaacgggcggttttcatctgcgggtttctgccgttgtcattggcaaaagtccattcccgcatagccgggtcggtaaagcccaggcgtttcagttcttctaccttgtcccggtgctttctctgctgttcggcggcttcacgctccatgcgctgcgcccgctggcagtcacactctgccgggtgtcggtcacgcccgaacagggcaaccttatcagccggaaaataggcttctttcggtgtccggcacttgccgcagtagagtagaccgtcctcacctgtgtagtcctccggctcggcggtggctgctggtatctgtaaactcatatcttcaaaagctggtttcatagactttctccctccttgtagctgtaatcgggtatgccctttttcggggcagctttagcggtatcgtcagccgcccatctgcggatagtggcggcatggttcttgtatttcctcccggtagaagcgatatagccggatagccggtcaatgtaatactcccatttgtcgggcagttctgctttcagttcagaaagctctgtatctgtcaaaatcacatttttatatctgccgtaagctgcgggggcggctcgtcccggttttaactctctctctttttctatctctatatctatctctttctttatctctatctctggtggacaaatgtccgcttttgcttcggacacttgtccactaagccgtttttgctctgaaatcttcattcttgccctgcgcttacgctccccctcggtagaggactgaccgatgaaaagctcgatattgctcatatacaaagccccgttgtccagcggttcaacaagccccagtttcataaagatttgcaaagccctctcgactgtgccgacctgctggcgggtaatggtggctatcatttgggcggtgtaggggatattttcgtcaagctgcaaagtgccgccgtatttcagcgattttaagtacagcttcaagaggatattggaatacagcataccgtcctgcatactttccagcagcacgatagcgtcatcgtcaaaatagctttctttcagtttgaggtaataatatttgcggttatctgacataatcttggttctccttatctgtggggcgggctttccatctctttgaataataccgggggcagagtaccacgatagccctaaaactctgcttgcagtcatgggtacagccccggcaaagggcattgaaagtaatgcggtttcgctcattgaggaagaacgcccattccagccgccgcttcttgctcattctcggcatgaaaaaacgctcctttcttcggtttggtcgggtatgaggggacaggggcaaaatctgtatgttcccggtgccattttcgggaaaaatctgccctgtaagccccgttggaaaggtcaggggtattgcggatagggtatggcatacccccctgccttttgtatggtttcggtatcatttcggggcggttcttaacgctcctgttcatgctttttctgtcggctcggtgtgccgtgtagtatctgctctgcgttccgtttggcggtggcaagctgctcatactcggcttttgcggtgcggtaggtgttgtaagctgcgtttttctcggaaatgagggcttcaatctccgtattcagcttggaagtggcgggcagcttctttcccggtgcaagcacctttagctggcgcagggcagcttcatagatgataaattccgcttcgtgggactggcggtagttctccgcttttctgccggacagctttttatgagcgtcaatggtggggcgggtgcggcggtaatcgttgacaacctttcgcagacttttcttgtcggaaatgctctgctcaatgccccgcagactttcccttgcttcggaaagagctttccggctgctctccacggctgcgtccagcttgtcaaggtcaagcagttcgttctccatgaggaagttgtgggtagccgccatctgtttgaggttgtgcagggaagcccaacggtcatagcccacgcccttgccctcagctcgcttggcttcccggtcaaccatgcgctgcaaggtgttgtctgccggggcggtttttgcggttttttcctctcgcaagcgttccttttgggtgtgggggtattcgggtatggctgtggtctgttcggcggctctgtgggcgttctgcgtgagcagggcaaggacagcagccttgtcaaaatcgtcccccagcttccgggctgtgataggctttgtcctgtccggcgtgaggtaggaaagccgcccccggctctccttgacagttacgccctcccgcaaaagcagggaagcaaactcgtcaaagctgccagcttgggaaagtgcctgccgtatcgtccggcgcagcttcgccttgtccgtttcaaacttggtgggcttggtcggctgtccggtggcttctctggcggcgttctctttatcaagggcaagctgccctttcttctgcgcccagtattcacgctcggtcactcggttcttgctgccatgcaaaaggtcaatctgatacagattttcccggtggcacatctccatgacttcggacttgaaatattccatagctgcgtctgtgcagcggtgcttgcagccgtccttcgtgtccgctggtctgtccatgtagggcagaagcgggacggcttcaatccgcaagctgtttatgacgatatgcacatgaatgttgccagagtgattgtgcccgtccgggtgggtgcagacaatggcttggtgtccggggaaatgctcgttgcaaaattcctcgcccagcgactgcgccttatcaacggtcagaccgttgtccgttccgtcccgtgggtcaaagctgatgatatagtggtgggatttcacatcttcccgtttttggttcttgccatagcggagattggagcgcagacaggcaacagcaaaatcttcttcgccgcagttcagcgtggcaaggcggtagccctcacggggaacaagccgcccgttttcatcaagggtgggtttcatggtaaactcgtcatgctcaaaagtgaggtaggcttccgctgctccgtagtcggcatttttagagctgatatgtttgaatgttgccaacagcttcacccactttctgcaagacttcaaacttcaaggctgcaaggtcggaaatggcggctcggacttcgccggacagggcgttatacggtacgccgtattcgttcagataccgggcaatctgattgaggttgccgccgatcctgccgtattcggcggtcagcttcccgacagcggcaagcagctcgtcgttgacgggggaaacggttatgatggggcgtatggctgccccggttatggcttgccggataaactcggcttggctcatgttgtaggcagaaagccgctgggcaaactcggcgtattcttcctcggtcatgcgtgtcttgactacccggctgcggtgcggcgtgttgtatcgttttcgcatggtaaaacctcctttctgtgcgtggtgtcctctcactaataggagaaaaacggggtgtgaagcggaactgtttttgaaaaatccgaaaaaatattttgagggatttttaagcggcgcaagccgcataagcagggtttggggaaggcactccccaacaagattcccgcaaggacaaaatgagcgataagcgaaatttggtactgcggtagaatcttgctctaagaaaagcacgctccggctcggcgtactttttgctcaatttctcctgttatgtcctactacggacaacttgcaattttgccaaacggaacggcaaacctttttcaatgccgcacactttaggagaaatgggcgcaaaaaaagcagcaaacctttttcagatttactgcttgtatgtgccgctgtaatgggcggcggttattcagttgtatcgggcggggatactcggctaaagcgaaacttaaataacgctttcagcagcgtttccgtgatgaagtcctcggcttccttgttagcttgtccgctgatacgggaagcatagcgtattcgccgcccataatactgcaatacggtgttgaccgcttccggctcgccgctggtagcctgtacgattgtgtcataggggagaagctcgttattcctcatgcgccagtccctccatttcctcgtaaagctgctgtatggcttttcggatatggtagcccgctgcactgcggctgcgtccgtaccgtctgccgatttcatgctgcggcatacgcttaaaaaaggacagatagagcatttcctgcttctgcgctggcagacgggagagggcttgtaccagcagcccattgcttaggataacggtatcgccgcaaagatggacgatgtattcctcgtccggctccggggctttgaaatattcatctgtcgtgcctaaaggatagtgcttttcatctgtgatgtagtcaagggatatttctcttttgtgtttcctgctccatgtccgcagcgctgtgtagctggcattgcggataacaattttacaaaaagcgtggaatgtgtactcgatatgctctttgtattcttctgtgcaagtcataggaaatccccccttccctccgcaaagagttgtggctggttgatagttgctttttatgatgacaaagggcggcagcactttttgctgtcgccccttgattacccatttgcgaaaccgggcggggctgtcaacggcgggctttagcccgttcatcttgaccgttgactgctccggctgggtttgctatttgtgttttaatcacttacctaaagaaattatttttctttccacgacttttcaagaaaatctgttaattctgggatttccatctgttttagaccagttatatttccatttctatctctttctgtaataatgccaatatcaccgtttgcagagtgtacctcagttccttcaaaagttccatcggtagcccggttatcagcaaaatagcagactgacttaccattaaaaaacagctggttttcgtcagaattataggttaaaccgtattgctcatactgttctaagttattagcagtttcttcgtaaatctgtttgttgattagttcattaaatgccttttgttcttccgtaagccctttttcatagtcttggtcagtggtatcccgaacattttcagctttgcttttttcaggttgagttgaagaaaaaacagcatatacgccaccaaccatcaaaagcattacggcaagagtgagaataggaacaattatttttttctgtttcatcataatattaaatcccttctttttgcaagttgataagtatagtatagtgttttcctcctttcacccataagagcagcaccatcacagaatgttacacatgatttgcagttttttaagctctaaagtataaagagtagctacctcacacaaagatagctaccctcaaattttatgcagctttactcgaaaatatcttttggtgcagtaggtaataaatcgcctttcttccaaataagctcacaattattaggtgtaccataatatacagcaatgtagtcctttttttcatggttaaacccataattcattatttcggtttctccatcggataattcttctttgataaccgttcttaatacagaaatatacaagtttctattttcgtctgtgtaagtcttaattgttcctccacagtatccgtcaagtagttctaatctaaaagtaatctgttcatcggtcagtgaatatgccgagattgaaatttgctctgggcttaccatgctattttgtcttataaacaaggcataatatgttccaaatatcgctgtaaggacgatagtcgttattacaattcctatgataaatgaccttaatagtgaacgtttccatgaatgtgccatcttccccatgacactgctttgtatgctttcagcattttcctttgtatcaaccacacattctgtttttagcttctgaaaaatattggaacacttttcacattcctgcaaatgctcctcaatcatttttctgctgtctgctgaacaaacttcatcataatacagcggcaacatatcttgaatgatgtcgcatgaaattttactcataactttcctcctttacttgttcaatgatttttaatttagctctatgaaaggttactcttgcccaactttctgttttaccaaaaagttttgctatatcctgataacttaattctcctaacacccgtaaagaaaagacttccttatatggctctggtaaattgtgtagcagtttatgtattccaaacgcctgctctctttgtcctaacaaaatctctatggaattagtatcaactatttcattctctacagaattaaggtcgatatttcttttcctgtgcttctcatacaagaaaaatgaatgcttcgcaatttggcacagccaagtcgttattttacagtcacctcgaaagttctcatagcttttcatagccttaaaaaaagtatcttgcgctaattcttctgcaagttcttcatcgtggcaaagagctaacagatatttatatacatcttcaaaatataaggtatatatgtcactaaaattaggggtattcaattatgcacacctcctttcagcaataagagtaggcaagtaacattttgttacaaaaaatatttgaagataacatcaacaaaatatattatagcgtgaccgtgtttgattttcaatttctgtaaatgcagaaacatggagtgttccccaaattatacggaatagcaggggtactgtcatatctaatttattgttgcttctttaccaaccatgagcattcgcgcccggattgtcgttgccgtagccttccatgaggttaatcacgccccagataccaagcccggctccaagtgctacaacaagggtctgcaaaacgtctactgcgctattgaaaaatgccataaatatatcctttctgccgcgtctgcggctgtccggcaagcggacaaaaggcggtcagcatatgccgccgcacaaaaaaaccgccctctggtaaaggcggctgtccccgcgctgcgtaagttctgcggcgcggcggtattcagttgtaaggggtgcggctcctgccgctgtgtactgcgccggaaagtaggggcgcgtatcatgtagccgatattgatatatgtgattgcttccattcctcctttcggtgtcccgctgtgctgccggacgggtattattcagacttgcgggaagtgaatagcttgcatagcaaggtgttcgcttcccgcaagttcacaaaggggtagctgccgcaaggcagcgtaggggaagtgtagcttcccctgtcccccggcggtctgccatgctgtcactgttgcgggataagcccccggcgcgtgacatactccgttgcaaaacggcggtgttccgcttctttttcccgccaatactcccataatgcagcgtcggcggcttccgcaacattcattaaaaaccgttcaagctgcttttgtttttcctctgcgctacgtttcctcatggtctgcgtcctcctgtaagtctgccgcgtcaatctcgtaatagtcaaaaacctcgtcgggtttgacaatggcggggcggcgtcttaggtgcttttccatgtcaaaggcgttcttcgggtctgcgtcggacaggtacttgtatttcgggtgcttcgttatgtcgaatttgtccgaaaagaacgggcgcaccccgcgtagctgcaagatacatttccctccgtccatgactgcaatttcatcttccgtcataagctgctttcccaatttctgatagttcagcccatgcgaaagctcccgcccccttgtttcggacgtgttaaagctgtctatcgtttcttttcctaaaatttccgatatttctttaagggtggttttctccttgccgcccaagaaaagcgtggtgtcgcagttgccgactatggtatcggcgttgtccttgtagattgcctttagctgtgactggctctgcaagatgattgacgcggagatttcccggctccgtatggtggctatgagcttttcaaactttggtatctgcccgatattcgcaaattcatcaagtaagcaccttacatggacgggaagccgcccgccgtattcatcatctgctttgtcgcacaagaggttgaatagctgtgtgtagagaatactcacgacaaagttaaaagtatcgtcggtgtcgctgataatcacgaaaagggcggtctttctgtcgcctatggtgtcaagctccatttcgtcggtttccataagctcccgcagctccttaatgtcgaatggggctaacctcgcgccgcatgagataagtatgctttttgcggtcttgcccgccgcaagtttgtattttttgtactgcttgactgcaaaatgttccgggtctttttcttccagacgttcaaacatgaggtcaaccgggttctggaaatcctcgtcgtcctcgcgggcttccgacgcatttatcatttcaagcagcgtcgtgaagttcttctcgtcctccggggcttcataccagatgtagccgattagtgcggtgtagtagagcttttccgctttcacccagaaatcctcgccggatttttccccgtcgcctttggtgttggcgataatggtattgactaacttcaaaatgtccttttcgctccgcagataggcaaagggattgtatttcatggattttttgaagttaatcgtatttaacactttgatacggtatttgtaccgctgcaacattttcccggtttccaaaatcagtgttccttttgggtcagtgacgatatacgacgttggaaaatcctttgacgtacattgcatgagcgacggtttcacaaagaaccgggtcttgccgctgccggaaccgccgattacaaggatatttttgtttcttgcgtatttcggctgcttcgggcggctgttcatggtaagccgttccgtctgcgttaaggggatattattctcaaataccgggtctgtgtacggctttatgtcgtcagccccgccccaacgcgccgaaccgtattctgtcccgcggcggtatttcttcgcgttcttgcctttggtatagataatcagccggacaatgaccgcccccgcaatgccaataagtaagtctgccgggtggaagctcggcgcgatactggaaaaggcggctgtaaaaccgtccccaagatgtagcagctttgcgcttgcgtccgcgccgggggatagacggacagccgcgcccactttatcaaagagccagacaaagagcagatacgggagatttaggataagcagcttcttgatttccggcttcatagcgatacctccctgtccttgttcttgacctttgcccgttccgcgttcttgccctgtgcggcttctttgagggtagagagcagctttcggatagagggctttttctcctgtgtcagcttctttgcggaaaactccttaaaggctgcggtcagcacgtccgcgtcccgccccttgaagaaaaccagatagcggggcgggctttccgtcgcgtcctttttcagcgcaaagtcgataccgtactttttcgccgtaccctcaaaggctttgatattgccctcggtaatctcaatgttggaaacgcccgcgttctgcttcataagctgctttaagctctgcttgccctgtggcggtttggaaagcggcttttttccctttgacagtatggctttcattgccttttggagcgtctgcgctgtcaatttcccggtcttgatgtaaagggctatggtcttttcgtttacttcgtcctgcaatttgtcgcgtcctcctttcgcgtttctttatggggcggcggtcagatacgcacccgcagcccgttcaaatcctcggctctgatacccacaagataccagttgtcgccgtactcaatccgggtcggcttccacttgccccgcacgaatacgtcaaagcactcgccgcaatgcaagcccccgtagtagctgtttaagtcaaagcggatgtcgtaacggtcggtgcgctcgtcaaataccaatgctcctgtcattttctgtgccataataaaatcctccttttgtggttgtgggtggttacaggctttcgccctcgctgcatgaataatagtccgggtcgccgtactgcggctttttcggtgacagtgcgccgcttgccatgtcatgggcgacaagggaagtgtaataattgccgatagtggacggggcgttgaaaagggctgctttcagatattgcttgatgttgcggattttcgttgtgttctcccgcatacagtcaagcacaaagcggatatgctcgccgtccagtttcataaacttagatttcacaagctctgccgggtagtcgtcccccgcaatccgtacccgctttctggcggtgcatacggtttcaagcatgaggtctacaatctcgtcaagcctgtcactgtcaaacttcatgtcctgtttgagaatgtcgtagtcgatattgtccttgatgatttcccggtatatatcaactgcgctctgtgctgccgcttcctttcctttccgttccggcggcgcagccgcttctctgcaaggtgaggggttaggggaaaggataggaatggaatgggtactttgttcatcagtaattattttttctttttttggtaagtcagttctttgtatatctttatttaattgcgttggattttccaacgtaggtttttccaatgttggtttttcctgcgttggattatccaatgttggattttccaatgtaggtaaatccggcgtaggcggctgcggctgctcgaatatcacatagtccgcgccccgcaagcgtcctttctcgtcgcgctcccttgaccggacgatatacccggtgcgttcaagctccttaatggcttcgcggatagcgtctatcttctcccggttgataagggataagcctttcaaggtgtagtcccaatcttcggggagtgacagcatttgtgataaaagcccctttgcctttagggatagctccttgttgcgtaggtggtggttgctcattacggtgtagcccttgttccgttccactctgaaaactgccatagttcatagctcctttgctttggatttgttacgcagtagaagcgcagtttcgggggataaggtataaatcccttgccgcgccagatacacacccgcaaaaccgcttgtagcaaggctttttctgcccctactgcgtaacaaagggcatgaaaaaagcggcgttcctgttctcccatgtagagagtaagaaacgccgcttctgcgtcgtattcagtttttagtacaataccctgcttgtccgtcgctcgaaaaaccttgattttccagtgttttcaaaagtatcgttatctaacgtcagctttcgacagaccagagtttaagcgaatgatgaaagacattgaagttggtaatgttgactgtgtaattgtaaaagacttatccagattaggacgagattatattgaagccgggcggttgattcaaaagactttcccggctttttctgtgcgttttatcgcattgacagaccagtttgattccctgacagcagattataatgagacttcattggtagtacctgtaaaaaactttgtcaatgattcctattccagagatatatccggcaaagtcagaagtcatcagaaagttaagagggaaaatggagatttcattggtgcttttgcagtttatgggtataagaaaagtgaggataaccggaatttgcttgtgccggatgattatgcagccgatattgtccgtaaaatatttgcatggaaaatagaggggtacagcaattttgcaatcgctgaattgttggatgatttagggatactttctccgatggaatataaaaagatgcagggtgagaagttccagacggggtttgtgaccggagtgaaaacaaaatggtcggcagttgcagtaaagaggattctgacaaatgagaattacaccggaaccttagtacagggaaaagaagaaaaggtaaattataaggttaagaaatcagtaatgaagccggaagaagaatggacgaaggtgcaggaagcacacgaagctattatttccatggaagattttgagattgtgcaggatttattaaagatagatactcgtgccggagcaggagagaagaaatcccatatctatgcgggcattttgttctgtggggattgtatggagccaatgatacgcagggtaaaccgatacaaaggaaaagaaaccgtttcctttatctgttccacaaaaaataagagtggagaatgtagcaggcatactatttccgaatcggatttgaatcatctggtattaaccggacttagacagcaggtatcattgtttctgaataaaagtaaagttctgaatgccattgaacagatggagataaattttgaagaagttgcagcttttgataaggaaatcgaaaggctgcatagcgagcaggacaaatatttaacgctcagagcaggtctgtatgaggatttgaaaaagcagattatttcagaggaagattttaagaatttcagagaaatatatgagcagcgttatcaggaacttcagcaggctatccataatcaggaggaaaccataaagaagctctttaagtcgggagttactgccggtatcaatctggagcggatgaaaaatgtcatgcagataacggaacttgacagagttactttgatttcctttgtgaagcgtatccttgtatatgaggataaaagagtatatttagaacttcggtataaggaattgttttcaaaggtggttatgcttgccgattatgtggaagcaggtcatagacttagaggggaggcggtgtaaatggctagaacctctaagaaaaataaggaaagagcaggtttgagcgtaaatgtaaagccttcaaaaatgtattctgttggcatatatgcccgtttatcggtggatgcaaatgaaagaaaaaatgagtctattgaaacgcagatagaaatagcaaaggcatttatcagcaggcagaaggatatggtgatatttgactgttatacagatgttggaaaaaccggaaccaattttgagagggaaggttttgaacgcatgatgcgtgatgtaagaacgcgaaaaatagactgcatcattgtaaaagatttatccagatttggcagaaatcatattgaaacaggaaactatatcgaaaagatatttccgtttatgggtgtgcgtttcattgctgttacagataactttgacagcatgaatgtatccggacagaatgaaactttgggtgtaaatctgaaaaaccttgtaaatgaaatgtatgcaaaggacattgcggtaaaggtaaaatccagcaggcaggcaaagtgggagcagggtagttataccggtggtgtagcaccctatggatacagagctgaatggattggagataaaaagtgtcttttcattgaggagacaacatcggatattgtgaaaaagatatttgatttatttctttccggtaagaatatgaaagaaattgttatatggctttacgaagaacgcattgtcagacctatggaatatcataagacggggcagatttattgtccggctggaggaaagcttcagcagtggtcaagaggaacggttaaaatgattttaacaaatccggtatatataggctgtctcgtacaagggagaacctgtgggaaagactatatgatgcgggacagacacgatattgattccgaagattggtcagtaaaagaacatacacatgaggcgatcatcagtgaggatatgtttttcgaggctgccggaaagtttgagaaatcttccgtatactgcaacaagaatggatattccaaaaggattccggtagatgaggacatatttgcagatgttctttattgtggtgactgtggttcgaaaatgaaaagaataagtgctgtaaaagtatttagtacgaatgatcgtgttcggacatacagctataattgttctaaaacggaccgtattgatgaggataagtgtgtttccaaaagcataaccctaaatgctttaacgagtattgtaaagcaggcaattagacaggagttttcattgtcagcaatgcgtccaaaagatatagtggaaagcaatgtcagggaagcggaaagtctaaaaaaagaatgggaaacagaacttcttgagttggagcgaagaattgataatatcacaaagcttggaagcgagcaatatttaaagtatcgcttgggagaaataaatgcagataattttaaacgcatgaaagaggagaacagcaaaaagattgcagcatatcaaaagaagcggactgatattacggaaagacttaggacaatagattatgaaactgttcagaaaaaccattttctgcgtactttggtaaaaggaaatgaaaaaacagagctgacagcagaagtaatcagaactttgattaatagaatagagatttatcaggatcatcgggtaaaggttatatttgcttttaagagaaacgagattcagttagcaggaaaggaggtcatttaggatggaaaggtatcagattgcgatttatattcgattgtcaaaagaagatgataaatttaaggaagaaagcaatagtattacaatgcagagaatccttttgcaaaggtatgtggcagagaacttttcggactatgatcttcttgaattttgtgatgatggatataccggaacaaattttgaacgtccgggaatgcaggaaatgttggaattggtaagagattctaaaattaactgcattgttgtaaaggatttttcaagatttgcaagagattatatcgagttaggctcttatctggagcagatatttccgtttatgggtgtccggtttatttctgtcaatgacaattatgacagcaagaattatcagggaagtattgcagatattgatgtgaatttcaaaaacctgctctatgatttatatagtaaggatttgtcacagaaggttcgttcttctcttgcagtcagaaaagagaaaggacagtatgtaagtggaaattgtcctttgggttacgaaaaagccccagaggacagacacgctttgttgattgcagaggatgaggcagaggtggtcagacgcattttctctttaactgtggaagggtacacatccgtagaaatagcaagattattcaacgaaacacaggtgaaaacaccgattgaatttaaaattgcgaagggcaagaccagcagagagccaaagggcgacagatttatgtggagcagcagtacgatatgccagatattaagaaacgaaatttatattggaaatatcgtacagaagaaatacacaaaggattttgttggaggtaaaaatcacttaaatccccgtgaggattggctggttacttataaccaccatgagcctatcatagaaaagcatatatttgaacaggtgcaggaaggtcgtggattaaagaaaaatccacagtatcattcgacacatccgcttgttggtaagctgatctgtgggtgctgtaaaaagaatttgcgttatcggagagggctcaatccatatttcacttgtcataaccgttactctaatatgttggaaaattgcgtggaaaatgtcaatgcaatgtttttggagcagtatgtcttgtttatgatacaggataaattacaggcagatggggaacttgaaaagttacgaacagaagaaatacaacggttagacggagaaattaaggaactaaaggagagacgacagctattaaatggcaggatacaaagattgaaacagcagaactttgaagcataccagaattacgctttaggaaagactgacggttttcaggcagataatataatggtaaaatcagtagagaaagaattggaagacttaaatgagactgttcggcagatggaagcagcttatgttaagatggaatgtgacagagacgctttaagtgttggaaatgaatttgcggtattgtcaaaagagatgctagaccattatatcgaaaagattattgtttatgatgaacagaatattgagatatgctggaaagaaaaaataagagtggcatagttatttgttttgattttgcacttattcaacattcaatgaatgatattctgacattggtttaacagcaggtatcggttttgaggaaaaaagcggtaaaaaccttgaaaaaaggtcaaaaaaattgtttgcaactacttgacaggagagggtattgattatacaaatccggcatttcgatacagtgacgggagcagccggatcgtccgtatctgggatcagaccatacaggatggaacgccgcctgttggtattttgtatggagcagattatacaagagaacagatcaatgcggcattgctttcggaaaatccgtatgatgtggtgccgtcgcgtgatatgaacggacatggcacatttcttgcaggagtggcatgtggaagtgagagtgaaaacggtgactttatcggggcggcgccgcagtctgagatcatcatggtaaagttaaaggaggcaaaacagtatcttcgggatttcttttttgtgaaagacggcgttccggcatatcaggaaaacgacattatgatggcggtttcctatttaaatggagttgcaaatattttaaatcgtccgcttgtcatctgtgtggcacttggaaacagtgcaggaagtcatgcaagcgagggatttctgccatcttatctgaattatatctgtggaagaagaaagcgtgtggtcgtgactgcagctggaaatgaggccaatgcaagacatcattttcaggggcgtatcattggagagatggaacatgaggatgcggagatcacggtggaggaaaatacaaaaggcttttttgtggaattgtgggcatctgcaccggaactgtatgcagtcaccataatatcgccttcgggggagcagattccacggattctggtgcgccgtggagcgtcagagcagtttcattttatttttgagggaacaacaattacggtggattaccggatcgatacaaaagagacggctagccagctcatatttttccgttttatccgaccgacaccgggattgtggacgatacgcattttcccgcagctgacagtgacgggaaactatcatctctggctgccgctgcgggagctgacggatggaaataatttttttcttcgttccaatccggagattacactgacttctccgagtgcggcaaggcaggtgatcacggtgggcggttatcaggcatcaaataccagtatctatgcggattccggcaggggttatacgataaccggggagatcaaaccggattttgtggcaccggcagtggatgtctatggtcccgggcttcttggtaactttatcacctttacgggaacaagtgcagctgctgcgatcacggcaggagcctgtgcgcagatcatgcagtgggcgatcgtggatcagaacaatacagtcatgtcgaatacttccatcaaaaatatgctgatccgcggcacggctaaaccggaaaaccggacctatccaaacagagagtggggatatgggacactcgatgtgtttggggcatttcagaatctgaggctgtgataaaagcaacggaatatttatttagaaattgtttagaaaaaacagcaggggtgtcactgagaattgatgaatatctgagttactgtggagaagtatctgagttattaaaaaatcagacagcatcacagaatgtttctacacaggatgcagacggcaaagatgcagacagttatgtatcgacgatcggaagttccgatgcagtaatgccaagtgaaaattataatgatatcttaaaagaaatccagaaaacaaaagcagaagctggtcagtcccagagttactcagaaaacgcaggacagacatccggacagaccacacaggcatccggaaccggtgcggctggaaataccggaggcggtggagacagcgatgatgagaccacaataacaaagacagttgtgatcaatggcgttacttatcttgaaacaacgactgtggagaacggtgtcaaaagcgtacagagaactgcaatcagtggagttggtgaagagtagtgactatcaaaaaaatccgaaggattaacgtgaaccttcggatttttttgctacaatcaggaaataccattgtatgaaattttttgcatgatatcaacaaatgttaaaatagcattgtatgaaattctttatatgatatcagcaaatgttaaaataaaattgcttgcaatttattacatgatatgataagatgtctattgttcgagcaattcgaaaacagaataagccggcgtggcggaatggcagacgcaccagactcaaaatctggcggtggcaacatcgtatgggttcaagtcccattgccggcattgaaaaaagattcagtttttactggatcttttttcttattcatgataatagaatgttcacggagcgcgcattctattatttgctcttggatgagataaaaattaaatatgggcgaaatatatagaagatagaggtgatttcatccattttataatagaaattcatttaacatacaagaaaatgggtgaaaaaggatgagatttcattataatagcccacgaaaatcaaaaagtcagggtgaaaacagcagaaatgaaggagtttcgcccaaaatgatagaggaagaagttgaaaatagaaaataatgggtgaaagtggtttgaaagatggaaatttagcccgttcatctggtggatgtctgttatgtgtggatcagagtgaaagcagagtaaatttaaacggaaaccccactcacaaattcgcaggaaagctttgaaaaagcactgtgtgatcagtaaaaaagtgtaattaatttttacattgcaataaaaaaatggaaaaccttgtaaaccaaagttccccatcattaagagaagagcgcgagacgggactcgaacccgcggccccgaccttggcaaggtcgtgctccaccaactgagccactcgcgcatatgtaaattgttttgtatctgtctgtcagacacattcgatatcatactatgggaaacaggatttgtcaacaaattttttgaaaaagttataatgaaagctgaaaatcatgcattttggagaaaaaaccattttttgatttaaaaaagaattaataatattcatctatatattaagtaggaaaaatgctataatacgggatgtctgatgagcaggatgcagacagtggacatttaaggaggaactatggaaaagaaaaaaataattatcccggttgtaaccattgcagtgattggagcagttggaggaaccggttattattatcgtgacaatgtgatagatgtggcaacagaggcatttgatgtagttgcagagaagattccgtttttacagtcgggaaaatcggatgataaagtgtatgttgaaaaagtttccaagattatgaatacatatacaggaaacaccaaccggtataatggtgttgtggagtcacaggacagttatgaggtaaatgtggattcgtcacgtaccatcaaagaaatccttgtaaaagtgggggatgaggtagaagaggggcagacacttgtcacctatgataccagtgagcttgagatgcaggtgaaacaggcaaaacttgaactcgagggaatccagaatgagattgacagttccaataaaaagatagccacattgaccgatgaattaaataaaacgacagatgaggacgataaattttcactgacgacagatattcagtcggaggaaaattccatcgaggagaataaacttgatcttgagagcaagaaccttgaaatatcaaaatatgaagaccagatcgatgcatcgtctgttgtcagcaaaaaatccggcgtggtaaaggaaatcaacgagaacggtacagacagtaatggcaataatgctgcgtttatgacgattcttcagacaggtgaataccgtgtaaaaggaagtatcgatgagcagaatgtatggatgatctcagatggacaggcggtcatcatacgttcgagggtggatgaaagtcagacatggaatggaacgatttcaaagattgatacagataacgtgcagaaaagtgatgacgattcatcttcagacagtagtgtctctgcaacaaagtacccgttttatgtggaacttccatctgcagagggactgctgttaggacagcatgtatatattgaacttgacgaaggtcaggacgatcagcagaaagaaggaatctggctgtattccaactatgttgttcaggatgacagcggtgcttatgtctgggcggcaaatgataagaaacgtctggaaaaacgttatgtagaacttggtgaatacgatgaagatcttgcagagtatgagattttatccggactttcactggacgactatatcacatggccgatggaaggactctatgagggtgtaacgaccgtgacagatgtgagcgaggtcgattattcttcgcctctttataatcaggatggcaccgagatgcttgattatggcactgagatgcttgattacggtacggagatgatgtatgaaaacggaatgtacgacacggaaatgatgatcgataatggtatgcagaattatgtaaatggcgatatggaagatggatcaggttatgatggagctgacgatggcgattctgcggatgatgcggaatatgatgactctgattacgatgattctgactatgaggattctgatgattcctatgatgattccaatgatatggaggtaggggaatgatactgaatctgcagaatatttacaaggattatcagcaggataagctggtcgttccggtattaaaagatgtttgtcttaccgtggaagagggagagtatgttgcgatcatgggaccgtccggttccggaaagacaacacttatgaatatcataggctgtctggataagccgacgagcgggacttatgagctggcaggagaggacgtcttaaagttaaaagacaagcagctgtcagatttaagactgcgcagtatcgggtttgtatttcagagttttcatctgatgccgagagagactgcggtggaaaatgtatcactgccgcttagttatgccggcgtgaaaaaaaaggagcgcagggagcgtgcaatcaaagcactggaacgtgtcggacttggtgacagggtggactttcgtccgacgcagctttccggtggacaaaaacagagggttgcgattgcgagagcaatggtcaataatccaaagatcttacttgcggatgaacctaccggagcacttgattccaagtcaggagagcagatcatggaactgttccagaaactcaatgaagagggtgttacgatcgttatgatcacacatgatccgcatatcgcatccaatgcaaaacgcatggtgaaaatcattgacggggagatttttgagggcgatgaaaaggaggatgcatcatgaaattaaaaaaagtaatcgcagtcattgtcgtacttgccgtcactgttggtgcagtcaccggaggaatttatggttataagtcgtatcagaagaagaatctggtggcagaagtacagtctgtttccagtttaaactatggatattatgggaactctgaaacaagctatggtgttgtgaccaatgattcttcccaggaagtatatttagatgattccaacaaagtgcaggaggtttatgtttcaaaaggcgatacagtgaaagagggagatccgctgatccagtatgatacatcggaggcagagatcgatatccagaggaaaaaccttgagatcagtacaacagaaaacagtcttgcgaaggcacagcattctttagagtcattaaaaaacacaaaaccggtggataagacacggccttctactgccagtactgcatcctcgtacataaataaaaagctgcaggaattagagcagaagaaagcctacatagagtcactgccggaaaaggatgcgaaggataaccgcatttataattatgtgacggaagattcggagccatataataaagacacggcagatgggacagcagagaatccttacatttattattgtaataaagatgtttttgcatatggaagtttttacaattcgctgcggccgcagaaaaaatcagatggcacctatacggatggaaaatatgtaaagtttattatctgcaaaaaagacagcgatgggaaaatggtgtttgaaagtgtggaaacaggagatgaagtggtggatgacagtactgagtcgaatggtgacacaaaagaagttacagtacagaaatatgagcctgtggcagatgacagtatttcaccgaatgtaaaagatgtcgatggaagtaccatgcctatggactatgataaaagccggtcctggtatgttttttcaggagaagaagttggaaaaagtcttcaggattatctggatgaacttgagaatgaagataactggaacgatgaagatgactgggaagagccggaaggatataccgaaaaagaacttgcagaggcaatcaatgacaaagaatcagaagtaaaaaaactggatatacagcttcgcaagttaaaactggagctggaaacgttacaggacagcatcaatgatggtgtggtttatgcaaaacttgatggtgttgtgaaatctgtgggagatccggatcagaaacaggatgatgggaatgcctttcttgtggtaaccggggatgacggactgtacgtgagcggtacgatcagcgaacttttgttagatgaagtcaaaccgggaacggttgttaccgcaaattcatgggaatcaggaatgacatttgaggcaaccgtaacgagcgtatcggattatcctgtgagtggcaattcctggggagaaggaaatccgaatgtttcttattatcagtatactgcatatatggaagacagttctgcactgaaaaatggagaatatgtggatcttgcaattcagacaaatcagtcagaaacaggcggaatttaccttgataaggcatatgtgagacaggaagatggaaaatcatatgttatgatcgcggatgagagtgatcatctgaaaaaacaatatgttgtaaccggaaaaacagtatatggtactgcagttgagatcaaatcaggactgacagaggatgacaggatcgccttcccttatggaaagacagcagtcgagggagcagcagtaacagaggatgaaagtattgaatattaatcaggaggaacaggatgtttgagaatataagattatcttttcagggaatctggtcccacaagatgcgttcctttctgaccatgcttggaattatcataggtatcgcagcgatcattgcgatcgtatcgacgatcaaaggaacgaatgaacagatcaaagaaaacctgatcggctccggagagaatacagtggaagtgtctctttatcagggcgagtgggaatacgagatggattacaacggagtaccgcagggagtgccgcttgtaacagacgatgtcatgagcgacattaaagatcttgaccatgtagtaaatgcttctgcttatttaagcagacaggattacagcggagtgtatcatttaaatactgctttttccggtggatatgtgcgcggaatcgataacagttattttgatacctgcaattacattatgaaagagggacgtgcttttacggatgaggatttcaaaaagtataagaaagtagctatattggatacggattccgcaaatgccctgttccagggagaagattcggtcggaaatacgatcgagatccagaaagagccttatacggtaattggaatcgtgacaaaggcgaaggtgttcgagccggtcatcaattccattgatgattattatacctatgcacaggatacggcaggttctatttatattccaaatacgacctggccgatcatctatcagtatgatgaaccgcagaatgttgtgatccgtgtggacagtaccgataatatgacatccgcaggaaaagcatgtgcagatgtgctcaataattatctgtcacccaaagatgatacgatccagtacaaagcaaaagacctgttagagcaggcacagcagattcaggaactcagcagttccactaatacgatgctgatctggattgcgggaatttccctgatcgtcggtggtatcggtgtcatgaatatcatgctggtatccgtcacggagcgtacacaggaaattggattaaaaaaggcgatcggtgcaagaaagtcaaaaatcctgaatcagtttttgacggaggcagcggtgcttacgagtttaggcggtgtgcttggtgtgatcgtcggtattatattagcggagatcatttcctatgtgacaacgatgccggttgcgatcagtattccggcagcgatcggttctgttctgttttccatggtcatcggtatcgtattcggagttttcccgtcctataaggcggcaaacttaaatccgatcgacgcattgcgccacgaataagcactttgacagcggtgcagatctgaaatggagattaacgtgaaaaaaatcgtgatgtttgaagggggcgtggagacgctcgcatatttctcaaaacagatggcagaacagtttgtaaaaatgggatatgcagtgttcttctacaacctgaaagatgaaaagggaagtgccaaaaggctgagaaaatttataaaacccggtgagaccgtgatgatcacgttcaattttcagggactcgaaaaggaagatggcgtttacagtgaaaaaagcggttatgtgtgggatgagtataagatcccgtgttacaatatagcggcggatcatccttactattacgataaccgcctgcatgatctgcctaaaggatatcatcacatcagcattgaccggaaacaggaggcatatttcttaaaatattatcccgaatatcaaagttttggatttcttccgttagcgggaaccgggcttgacggggcacttgaggtaccttatgaaaaacgggatatcgatgtgatcatgaccggaaattatacaccgccttcgttttttgaacagcatatcaactggatcaatgatgagtatgcggcgttttaccgcgggatcattgaggaattattagaaaagacggaccagacagttgaggaggcagcactgcgccactgtgagcgggagatgggaggagttgcaccggatgatttccggcttgtgatgcacaagatgatcttcattgatctgtatgtccgcaactactggcgcggaatggtcataaagacactggcagaggcgggaatcaccgtggatgtcattggaaaaggctgggaggaacttgaatgttctgccatgcagaatgtgaggatccatccgcagactgattccctgacttgcttagagcagctttcgcacgcaaagatctcggtcaatgtgatgccgtggtttaaggacggtgcgcatgaccgtgtgtttaattccattttaaacggggcagtctgtgtctcggataccagccggtacctcagtgaagagttaaaagagggtgagggtgtttcctattatgatctgaagcatttagagcagctcccggtaaaagtcaaagacctgctggcagatgaaaagcagatgagagacattgccatgcggggagtggaaaagacagcagaaaagcatacctgggcacagcgtgcaatagagctggaagaaaaaatcagggtatattagacttgcattacggaaataatgagtgtataataacgtcagaaattggcagtgatggaagctgcggcagcaggaatgtttcagagagccggtggatggtgagaaccggtacaggaaaatgcctttccacttccggagtcagtgatgaaagtcacggggtcgtatcccatagcatacgaatcgagaggtcattgcaaaaggatttccacaaaaagctttggataagaatgctgcagtgacaagatgggtggcaacgcggaagagtgatttatagcctttcgtcccatgtgcaggatggcacacagggcggaaggctttttgtgttatcaggaaaaatgtcagacagagatttgctgtccggcaaaatcagaaatttacaaaaagaagcggcaggttccgcagaaagaggagaacgatgatcgatttaaaatttttaagagagaatccggaagttgtaaaacagaacattaaaaataagtttcaggatcacaaacttccgttagtagatgaggtaattgaacttgatgcaaaggcaagagccgtacagcaggaagcagacgatctgcgtgcaagcagaaataaactgtcaaaacagatcggacagttaatgggacagggtaaaaaagatgaggcagaagcagtaaaggcacaggtaaatgccaatgcagcacgtcttgcagagttagaggagcaggaaaaagaactgcaggagaaagtaaccaggatcatgatgacgatcccgaacatcatcgatccgtccgtaccgatcggaaaagatgacagctgcaatgtagagatcgaaaaattcggcgatccggtcgtaccggatttcgaaatcccatatcacacagacatcatggagcgtttcaatggtattgatcttgatgcggcaggaaaagttgcaggaaacggtttctattatctgatgggtgatatcgcgcgccttcattccgcagtgatttcctatgcgcgtgatttcatgatcgaccgtggatttacttatgtcattccgccgtttatgatccgaagcaacgttgttacgggcgttatgagctttgacgagatggatgcgatgatgtacaagatcgagggcgaggatctctatctgatcggtacttccgaacattccatgatcggtaaattcatcgacacgattaacgacgaagaaaaacttccatacacactgacttcctactctccatgtttccgtaaagagaaaggtgcacacggtatcgaggagcgtggtgtataccgtatccaccagttcgagaaacaggagatgatcgtggtctgcaaaccggaagaatctaagacgtggtatgataaattatggcagaacacggtagacttattccgcagtctggatatcccggttcgtactttagagtgctgctccggtgaccttgctgacttaaaggtaaaatcctgtgatgttgaggcatggtctccaagacagaagaaatactttgaggtcggaagctgctcgaacttaggagatgcacaggcaagacgtttaaagatccgtgtgaaaggttccgatgggaacaaatattttgcacataccttaaacaacacggttgttgcaccgcctagaatgctgatcgcatttttagagaacaacttaaatgaggacggaagcgtcaatgtaccgaaggcattacagccgtacatgggcggaaaagagaaactggttcctttgaaataagaagaaacagctgtggggacgagatcctgaaacagtgaaaaatataagttataacaaaagaagtgtatgttcggtgattcccgacatacacttctttgtttatgacaatagaatgattagcatttctccggttccggataatctacaccgaaagtttcaacggtaacagttttcatgcgctgtggctctaatggtctgtcactgtaatcagttgctgtctctgcaatcttatttacgatatccattccctcagtgatcttgccgaaagccgcataagctccatctaaatgtggagaagttttgtgcatgatgaaaaactggctgccggcggaatccggatgcatagctcttgccatggataaaacgccctctgtgtgtttcaggtcatttttgaaaccgttctgggaaaactcacctttgatgtcatagccaggtccacccatgccggttccgtccgggcatccgccctggatcatgaatcctttgatcacgcggtggaagatcagtccgtcataataaccgcttttaattaaactgatgaagttgttgacagtattcggggcgatttccggatacagttccgctttcatgatatcgccattttccatttcaatcgtaacgattggatttgccataattgcgtacctcttttcaaaataatagtgcctgcagatgcttgtaacatcattacaggataccgctttattgtagccgaaaaaaaacgagtagtaaagtaaataatttaagaaaatctttgcttgaattaagacttcttacagggtaacataatatagagaagtttcgtacgaaaatgggataagatattttacgatataaaacagttcagaattgggaggattggatatttgggtcgtcagaaaagaaaggagtacgcattttatgcagtgttagccggaacatttctgctgatcacaggagcgtatggttccggtgaaaagtctgtgcagcaaaatgcgaaagagatgggagcggtggcagagaaggcagtcgccgaaccggagtatgtgccggcagtcagactgtatgccgggatttttacaaaattagacggggaagagtatgccgtgatcgaaaaaaataaggacattctggtggctgccgcaaaccggggatattttgatgagtcggatgtttattcatttttacagggaccaaagtcctggggagagggacgggcatggtccggtgaatggagcaatcagtatgtgcgcggcaactattttggcaatttcgggtgcggattgtgctgtatggcaaatatatacagtacattttcaggtcatacctgttcgccgtgggacatgtttttgtatgcaagagaggtctccggttacacaccgacgaaaaagatcggtgcgatcggctggggcgatatgaaaactgtcatgcgcaaatgtggatttgatgcggagctatacacaaagccgcaggattacgaaacttttcgggatcaggtcagatctgcaaagagtgtagttgttttggtcagcagccatgatgacaatacttactggaaaaagacgggtggtcattatgtaaatatcagtctttataaggaagataccgatgaagtgtttcttgcagacccggcggatcctgatggaaaccggaattatataccgctgcgctatgtatatgatgctttaaaaacagtcagtaaatatcagtatttgctggtaaatggatattccgaggaacagaaccagtggaaacaggatggaattgatgaggcgtgggttgcaccgtgagaatgacatctgttataatggcggtaagtttgtgaaaagtgaattttggttacagattttgttagaatggagaagatatgaatcaggaagaaagaaggcagaaaagacaggatgagttcaaacatgcagcagtggtggttaccgtatttgtactggtcttggcagtaatgatcattggggcggcagctgccctgcataagtttttgccaaagggcacaaaggaagtaaagacaccggacacacagagcacggaaatttcagatgatacacagacatcacagaatggaagtgacgtggcagaacctgccgtggacccgttagatgagcaggcagcgcagcttgtatcagggatgtccttagaggataaggtggcgcagatgtttgtcataacaccggaagcgctgacgggatataccagtgtgacggcggccggagatacgaccaaaacagcatatgaaagcagaccggtcggaggtctgatctatatggcagacaatcttctcagtacagaacagacgacagaaatgcttaccaatatgcagaacattgcaatggagcggacgggactgccggcattcttaagtgtggacgaggaaggcggaacggttgcaagagtagcggcaaatgaagcatttggcgtgacaaatgttggaaacatgagtgatatcggtgcggctggtgatgcgcagaaagcatacgatgccggtgttacgatcggaacctatttaaaacagcttggctttaatgtggactatgcgccggtagcagatgttctcaccaatccgggtaatacagcgatcggaaccagatcgtttggttcggatgcgtctatggtggcagatatggtcacaaaagaacttgagggactaagcagtcagggcgttttcggcgcagtaaaacattttccgggtcagggaggtgtctccggggattcccatgacgaagcggtgacgttggacaagtccttagaagaattgatgcagacggaacttgttccattccagaaagcggtggaaaacggtgtatcgtttgtgatggtcggacacatttccgttccacaggtagtcggggataacacaccggcatccctgtcacagatgatggtgagtaatgtgctgcgggagcagcttggctatcaggggatcgtgatcacggatgccatgaatatgggtgcaattaccggaacttacacagcagaccaggcagcagtcatggcagtcaatgcaggcgtggatatgatcttaatgccgcaggattatgagacagcatataatggactgcttcaggcggtacaggatggaacgattacggaggaacgcatcgacgaatctgtggagcgcattgtaaaagtgaagctgcagatgcagtaaaccaaactttacaaacaacgaaaaaaataggataatagtaataaaatttacatatgagatacgaatggggaatacgacatggaaataaagcgcgtaggagaaaataaaatcagatgtgccttgaccgaggacgagatccgggagatgggatttgatattgatgagatcattggcaatggagaagcaacacagaagtttatgcgtgttgttttaaaaatcgtggaggaacaggagaatatcagccttgaaaatatttctccgatggtaaaagcagagctgctttccgatcacagcatggcaatcacatttggcggagattccgatctgagttttcagcagctgatggatgcgatttcggatctggttgggcagatgacaccggagaaaatgcaggagtttagaaacctgagcaaagaagaacgtcagggagtgttagacgcattcttagaccagaagaaggacacacaggaacagagagtagcagaagagaaacaggaaaaagaaaataaaaagaagccatcaaaacaacagaaagagctgaaaaaacggcagatgatctgcgcactcaggttctttgatttggatgaggcatcacgcatgggaagagcttgttttgaggagatttttccaaagagcagcctttaccggttagagggtgcatactatctgatcatggacttttcgaagttcccgagggacgaaatgagggcgtttgcattcggtgcagtcgagtacgatgcgggcagaatttcagagataggacaaatttcctatatccgtgaacacggagattgtattgttaaaaaagaggcgctgcaaacgctgatggcgttgtaacaaatgaataaaagatagtttgtaaataggcaaaacaggaaaatccatctttaaaatttggtgaaattgccgaacaagttgatgtcctgaattttaccagatatgctattatgtcataggtgcgtgcacggcatctggttatacttatgacaaaagatctatcatattcaggtaggtcagagatgacagtatagaataagagcaggagatggagaggcgttatgagcagagagcagcttttggaactcgaagacatgaaaaggggacttttagtacaggcatatcgcatgaaacaggagtgcccgcatatgtcgccagtgggattagagcatgaaatgtatgtggctattatggcagaggtaagagatattacagccagaatacaaaggtctgcagaagcatagcggaacaaaaaagtaaatattgtatgaatgatacaaaagaaggatcagtcaatggaatgaggtacgttggctgatccttcttttgtgtcgaaaaaaagagtctgttttacatattgactgaaaaaatagcggaaataatgccttgctatcagattaagaaatgaatataattaatatatcagtaatttttggggaacgtaatagacagcagaaaggatacgggggttattcatgaatgagatcattacgaaacttgatgagatcgaaaagaaggcagagtcaattctgacggaggcagctgcagaaaaagaaaagatgttaaaacagttagaatttgataaacgtgagatggatggacgatatacttccatgagacaaaaacaggaagaagagataaaacagcagcttttatccgaagctgagactaaaattacacggcagagagaacattatgaagcggcaaaaagacggttagaagaggattttgcgcagaagaaggattctcttgcggagaagatttttgagagcattataagtccctgatgtgtgcgtggcgggtggcagagaagaaaaagcagcgtgacggaatgggggaagaagatggcaggaggactgttagagtacagtggtcttgtgacaaagacaaaagcgatgcgtgcaagactgcttggtgcggatgattatacggcaatttctgaatatgagtctgtgacagactttattgcttttttgcgggagcagcctgcttatgcgccggtatttgaacgacacggggaagtggcacaccgcggtcaggtggaggcggtgatccgggattcgctgtatatggattactgtaagctgtaccggttttccggtgtacagccaagaagagcattgcagtttgtgttttcacgctatgagatcaatgtgataaaaaactgtctgcagtctgcgatggagggaaacgggcgggagatcaccgtaagcggaggattttttgaacggcatgcagattttgacttaaaagcggtgatggcggcaaacagtgtgcaggagctgatacaggcggtgacaggaacggaatatgaaagcctgttaaaggaattagaatctgcagcagaaaagagttatgcagattatgcatttgcacttgatatttattattataaaaaagtatggaaagaaatcacaaaggtttccgataaggagacaaggcagatcttagaacagattttcgggacagagatcgactggcagaatctgatgtggatgtaccgtgcaaagcggttttattcgatgggagaagcggatgtgaaaaaacaccagatcccggtaagctaccgattgagatctgctgagacgaaacggcttttagagacggaaactgcagagcaatttgtggaatttgtccggcagaccgcatattttcgtggaaaacaggcggtgttagagccggaggatgaactgacgtgggagagagtcatgataaggacatatgagaaaatatgcaaaaagcatccaatgtccgtggcaccggttctgcgttatctgtatgaaaaagagcacgagatcgatcttttaacgacggcacttgaaggaatccgttaccgtataccgccgtatgagatccgtgatctgatctttgcgatgtaaatataagaatcattgcggtagacactgtgatgatgggatggaggggtgcaagtggtagagaaaatgaagctgcttcatatcaccgggccgaaaaatgatgtcgaccgtgtgatggagcagtacctgagcagatatgagatacattttgaaaatgccgcatccggatttggcatatccggtcatgtgagaccgtttgcagagacaaatatctacaaggatgcatgcacaaaggcacaggcgttgtgggaacacttaaaggacgagcccggtggggcagcagactatgccatgccggtaaaaatggagccagcggaagcggaaaaagtggtggaagcggcataccggctgacagatgagatcgtgaaacggcaggaggaagtgcggaaggaacgcatggagaatcagagcctgatggatcagatcgcaccgtttcggcggcttgattacgaatttaaaaaaattctggaatttcagtttatcgcattccgttttggaagaatcgcaagagagcattatcagaaactcgaacgctatatccatgataccgatcatgtattattttatgaatgtgacagtgacgaggcatatgtgtggggcggctattttgtgccaagagtctacgcaaaagaagtagatgcggtgtgtctgtcgtttcattttgagcgcatctatataccggattcttttgatggaacaccggagagtgcttatcaggaggcattgcagaaaaaacaggcatatgacgaggaagagcagaagttaaaaaagcagcttcatgataccttggaaaaacatgccggaaagatcgcgggtgcatgtgccgcattagagcattactgcaacaattttgatgtgcgtaagtttgcagtctgcacgacatccggaagaaagccgggagagcagaccgaatactacattttatatggatggatgagcgcagatgatgccagaaaattagaaaaagagacggcggaagattcaaagatccatgtgatggaggaggatgtggaggagcatatgtccgtcagtccgccgacaaaattaaagaatcctgcgctgtttaagccgtttgagatgtttgtggaaatgtacggacttccggcataccaggagatggatccaaccatatttattgcgcttacctacacgctgatgttcgggatcatgttcggggatgtcgggcagggactgtgccttttgatcggaggatttgttttttaccggatcaggcacatgaaccttggagcgattttatcgttagccggcatctggtctacggtattcggttttatgtatggcagcgtgtttggattcgaggatatcttaaagcccgtgtggatgcgtccgatggataacattatgacgacactgatgttagcgatcggatttggaatgtttctgatcctggctgcgatggtcttaaatatcatcaatgccgtgcgtgcgaaagatgtgggacggattctttttagtccgagcggagtcgcgggtattttgtgttacggatgtgcggttttatgcattgtactttatgcatttgaaaaaccggttccggctaccggcattcttgctgtttttgtcggagtgccgctcattgcaatccttttgaaagaaccgcttacaaatctgcttgaacgaaagaaaaagctgtttccggaaggcgagagcaaggcgatgttttttgtggaatctctcgtggaattgtttgatgtggtattaagttatgcgacgaacagtatatcctttgtccgtgtcggagcgtttgcactcagccatgcgggcatgatgggagtggtgctgacgctcgccggatatgagagtggttcgccgaactggatcgttgtggtacttggaaatatcgtcgtgacaggtcttgagggactcgtcgtagggatccaggtattaagacttgaatattatgagatgttcagccgtttttatcagggaaccggaaagccgtttgtggcattttccggaaacaggaaataggaggagaaaaagatatggcagcaaaaataacactggtggcaattttaattttcagtatggtgatcccttttctgggatatgtgctcggaaacaggaaagagaaaagttttaaggcatctcttgcggtaaatttggttctgtttttcggaacagttgtggtggcagatatgctgcttttcagcgggcatatctatgcagcatccgataccgcagcatccgcagcagagggatggagatacatggcggcagcactgtcaaccggactttcctgtatcggtgcaggtgtagcagttgcgagtgcggcatccgcagcaatcggagcactgagcgaggattcaagtattatgggtaaggcgctgatcttcgttgcgctggcagaatctatcgcattgtatggacttttgatctcattttccattctgggataaaagagacgggaaggatggcggatttccatgaggatgtatttgatcagcgataatatagacacatacacggggatgcggctttccggtgttgagggtgtggtcgtgcatgagagagaagaacttgaagaagcgctttcctttgtgacgggacagccggatatcgggatcgtactgctgacagaaaaactcggcagggattttccggaactggtaaatgatttaaaactgagccggaggacaccgctgtttgtggagatcccggacaggcacggaagcggcagaagcaagaattttattacggattatgtcagtcaggcaatcgggctgaaactgtaaacgggggatggatgcatggagatcaatgaaaaactggaagttttttttggagctgcgatcggtgctgcaaacagccagagcgagtcgatgctcgatgagcagaaaaatatttatcagtcggcaatggaagaacatgagcagtcctgccgtgatgcacttaaaagctcaagacgcattttcttagaaaaacagaaaaaagaagtaaaccgcaggaatgcagagcagacaatggcgtggaaaaaggattatcaggcgctcaaagagcagaagacggaagaattgtttgagatggtgaaggaaaagcttttatcgtaccgccggacggatgcgtatgaagcatttctgcttgcacagataggtaaggcaaaagaatttgcacagggagaggatctgaccgtatttatcagtccctcagatcaggagagacaggccgtccttgaagagaagagcggatgcagggtagagatcgctgaggatgagttttccggcggcatgcgggcagtcattccggcaaagaacgttctgatcgacgaatcatttgcagagagaatgaaacatgcgggagagatatgctggatatgatgtaaaactgttatgtgccgggagacagcacaaaaacagagagcagtttgagaggatcagatatgggtataacaggaaagatatacgggatcaacggaccggttatcacgatacagggaaatcttggttataaaatgaatgagatggtatatgtcggagagcaccgtttagtcggggaagtaatccggctgtcgaaggaaaagacgaccatccaggtatatgaggagacatccggattaaagccgggtgaggaagtggccggtgcgggctgtgccatcagtgtaaaattagctcccggaattttaaataacatctttgatggtattgaacgtccactgcaaaaaatcgcagaaaaaagcggagcgtttatcccaacgggagcgcaggcagatgcactggatcgggagaaattatgggagacgcatatcaccgtacaggaaggtgacgaggtggcagggggttctatcatagcggaggtgccggagacaaagtcgatcgtacaccgtgtgatgcttccgcccggagtatccggaacagtgacggcggtaaaaccggatggagattatacgatctgtgatgagatcgtaacgatacgcactacagacggcggtacaaaggcacttaccatgacacaggagtggccgatccgcaaaccgcgtccggttaaagaccggtatccggcagaccggccgcttgtgaccggacagcgtatcttagatacacttttcccgatcgcaaagggcggcacggcggcattgccgggaggatttggtaccggaaaaacgatgacgcagcaccagcttgcaaaatggtgtgatgcggacattatcatttatatcggctgtggggaacgtggaaatgagatgaccaatgttttggaggaatttggagaattaaatgatccaaagaccggcaatcttctgatggaccgcaccgcgctgatcgcaaatacttcgaacatgccggtggcggcgcgtgaggcgagcatttataccggcatcacgttagcggaatactaccgcgacatgggttatcatgtagcaatcatggcagattccacgtcgcgctgggcagaggcattaagagagctctccggaaggcttgaggagatgccggcggaggaaggtttccctgcatatctggcatcgaggctttcggcattttatgagcgcgccgggtatgtgcagaatttaaacggttcggatggcagtgtgacgatcatcggggcggtgtccccgcagggaggcgatttttcggagcctgtcacacagaataccaagcgctttgttcgctgtttcctcgcactggacaaatcacttgcctatgcaagacattatcctgcgatcaactggctgaccagttattcagagtatattcctgatctgacggcatggtatgagacgaatgttggcccgacattcgtgcagtgtcggaatgagatcttgaatcttctgacgatggaaaatcgtctgaatgagatcgtaaagctgattggaagtgatgtgcttccggacgatcagaagctggtgcttgagattgcgcgtgtgatccggcttggatttttgcagcagaatgcattccacaaagaggacacctatgtgccgatggaaaaacagcttcgcatgatggagatcatccttcatctttacgaccgctgcaaggcactgatcgaccggaacatgccgatggcgcttcttcgggaaagtgatatatttgagaagatcatttccattaaatatgatgtggcaaatgacaaactagagcagctaaacctgtatgatgataagatcgaagaattttatcagcatctgatggcggaaaatgcgtaaggggcggttgaacacaaaaatgtagattcgtgtgaagaataagctgctcagaaatgaggattgatatggcgattgagtatcttggactgagtgagatcaatggaccactggttgcagtagaaggtgtaagaggcgctttctatgatgagatcgtggagttggtcgtggaaggaaaacagaaaaaattagggcgcatcgtggagatcaataatgactatgcggtcgttcaggtgtttgagagcacggaggagatgtcccttttaaatacgcatgcaaggttaacaggcagaccgctgtgtgtggggctgtcggaggaaatcttaggaagaacattcaacggtctggggcagccgatcgacgggctcggcgcggtgcacgccgaggttgtgcgtgacgtcaacggacagccgatgaatccgtgcagcagggaatatccgagaaactatatcagaaccggtatctctgcgatcgatggactgacgactttgatccgtggacagaaactgccgatcttttcaggcaacggtctgccgcatgatgagcttgccgcccagattgtggaacaggccagtcttggggatggcgaaaacgaggacgaaccgtttgcagtcgtgtttgccgcgatgggagtcaaatatgatgtggcggagtattttaagcgccgttttgcagaatgtggtgtaagtgaccatgttgcgatgtttttaaatctctccaatgatccggttgcagagcgtctgatcacgccgaaggtggcgctgacagccgccgagtatctcgcgtttgagaaaaatatgcatatccttgtaatactgaccgatatgacttcgtttgcagaggcgatgcgtgaagtttcggcgcagaagggagagatcccaagcaggaaaggctatccgggatatctgtacagtgagtttgcagcactttatgagagagccgggatcgtaaacggtgcatccggttccgtcacacagattccgatcctgacaatgccgaatgacgatatcacacatccgatcccggatcttaccggatatatcaccgaggggcagatcgtactggaacgttcccttcaccagaaaaatatttatcctccgatcaatgtactgccgtcactgtcgcgtctgatgaaggacggtatcggtgaaaaatataccagggaagaccatcaggatcttgcaaaccagctcttttcctcctatgcccgtgtcggtgaggcgagagatcttgcgagtgtcatcggcgaggacgagctttctgatgccgataaacagtatctgaaatttggtacagcttttgaaaaagaatttatcgggcagggaaaagacgaaaaccgttcgatggcggaaacgctggatatcggctggcggctgctgcatatcctgccgcgtggagaattagaccgtattgatacaaaaattcttgaaaagtactgggattaggaggggatgacgcatggatccgaatacgtttccgacgaagggaaacctcatattggcaaaaaatgcgctcgcattgtcaaaacagggatttgacctgatggataaaaaaagaaatatcctgatccgggaactgatggagttgatctcagaggcttcggatatccagaaccagatcgatgagacattttccaatgcctaccaggcactgcagaaagccaacatccagatgggaatccatcaggtagaacagattgcaaaagcggttccggtggagaactccattcgtatcaagcggcgcagtgtcatgggaacagaaatcccaaaggtagagtatgagaaaaagaagcaggcaccggcatattctttttatcacacaagaatgtcattagatgaggcgtgccagcagtttgaaaaagtaaaagaattaacgatccgtcttgcggagatcgaaaactctgcataccgccttgcctataatatcaaaaagacgcagaaacgcgcgaatgcactctcgaacattacaattccgaagtatgaaaaactgtcgcgtgagatacaggattatctggaggaaaaagagagggaagagttcacaagacagaaagttgtaaagaaaaaccggatgaaaaatgcaggttccgggatgatgtcataagaataatgaatgaaaaataagaaagccgaaagcggaataaagtgtcgctttcggcttttattcatgacaatagaatgttcgcggagcgtgcattctagcctaacattttatgaaaaaatgctaggtagcagattattttttgtaggtgtcagaaaacagatcacggtaccatttcagggcagaaatataggcatcatacacagtctgtgtgtcaaggttttccaggatcataagccgggaaacttcggaccagttacctgcctcatattgtttgatgaaatataaaggttccgcaaaaataccactctgacggatgagagcatcttcgatatcgcgtgaaactttgacaagggataatgcttcctccattggtttatcgaggatgatatcaagcacggaaaacagtccggttaagaatagttcggaagctttgccgccaagctcaaaggcaggggcaagattttctgcaaactttgcacgcaacagggataaacgcgtaagctcgtttggcttgtcggaacacaactgattgacaacggcggtgttgatccagcgtttcagttctttctgtccaagcatggcagctgcgtgccggatggaagtgatctcagagttgacagccatatgattgaccatgcgaagcagtgagatgacaagagcggtgtcatgaccgatgatatctgccgctttggtgaggtcaaagtcctctgtattaaccagattcataagttcaatgtaattgatctttaacggagctacgtcatggtttccctttgtgacagggagtctgtaaaaacttccctcatataaagtgcagctcttatcctgacagattgcatcaaatgtctctgttttggttatatttgaagcacagagtttaatgtccggataaactttattgaaataaatgcgtgctttgctgatgtcgatttcttcacagtctaacatgacataatccatcagtacgagcagatcatggtaagcttcgtaacttgatacaggaagcttgcggatggcaaatcggtatcccatctttttcagtgctttgacacggtcaatatacattggtgtgcatggaatatttccttttaacagcagtacgaaaaattcgtgtggcagaccgcactgagcaggaatatcggaaaaaatcgatatttcatttaccggaacaaagatttcttttgccggggaaagagtttcaagtcccatatttaagatcagttcaaatccttcaatctgggcggcgccatcattgcttccgcttcccaaaagattcgggtgaagcagaaaatttgctttctgtgtatacagagaatatgcgctgacttttatgttttcatcaaatagaggtattaatgtaaccagcataggcgttctccttatagcatggaatcttttgtgaagaaaccatgtgaaacgttaacatttatctacttttactatactataaatctgtgaaaaaagacacatttttttgaaattaataaacagaaaacttattttatgaaaaataattgaaaatacttgatatttcagaatgaatgtggaaaactaatgacagaagaatgggagggatttgcatgttaaaacaatgggaaaaaacagagcgtccgtcagatgcaaaactggaggaacggctgcaggaagcacggagaaaactgcaggagcagcagctcaaggtaaaagagcacggactgccggtgcttgtgcttgtggaaggatggggaaccgcaggtaaaggctcactgatcggtcagattattaaaaacattgatccgagattctttaaagtagcgtccatggcggcaccgacggaggaagaaaagagaaaaccgtttttgtaccgccactttgtaaaaataccggagagcggcaagttcagctttttagactccggctggatggatgagatcatgggtgaaagactgcatgaaaagcttggagacgaggcatatgcgcaccgcattgagagtgtcaagcggtttgaacgccagctgacagataacggttatctcgtcgtgaaattatttttgcaggtgtctaaaaaggaacaggaaaaacggatcgaacatctttctaaggagaaggataccagatggcgtgtcagcaggaatgaccgctggcagaatgagcattatgagaaatgcctgaatgcatttgattcctatttaaaggaaacaaatctgccgtcagcaccgtggtatatcattgatgcagaatcaaaaaaatggacggagttacaggcacttgagattctgacggaaggaattgatgtggcgcttgccaataatgcgatggcggtgccaattttacagaatgtattttccatggaaaaaatgcccctgttgtcggagatcccactggataagacaattggagaggacgagtataaaaaagaactgaaacgtctccagaaccgcttaggagagcttcataaccgtctgtaccgcaaaaaagttccggtcatcattgcatatgagggatgggatgcagcaggaaagggcggcaatatcaagcggatcaccggagcactcgatccgagaggctatgaagtacatccgatcgcaagcccggagccacacgagaaggcgagacattatctctggcgtttctggacgaggctgccaaagacaggacatatcgcgatctttgaccgcacctggtatggcagagtcatggtggagcgtcttgaggggttctgcagcgaaaatgactggaaacgtgcctataacgaaattaatgaatttgaaaaggaactgcacgactggggcgctgttatcatcaagttctgggtgcagatcgacaaggatacacagttagagcgttttaatgagagacagaacactccgcagaagcagtggaagatcacagatgaggactggcgtaaccgtgaaaaatgggatcagtatgaagatgcagtcaatgagatgatccagaaaaccagtacgacatatgcgccctggcatatcttagagtcagtggataaacggtatgcaaggatcaaagcattaaagatcgtgatcgaggagttagaaaaagtgctggagtgatgtatgtggaaaggtgcagatgtttttgaagtctgtcaggcaaaatgaaatacgttgggcgaaacaagtacaggatatgcttgtttcgcccgtttttttgaaaagcagttgacataatattgtcaaatgggcgaattaaaagaacttttttttgaaaaacagccacatatatcgaaattcgtgggtgttttgtatgatacaggatcgttttcacccaatatcatacaaattcataaaatgagacagtatttttggatgaaaagattgaagtaacatatcatttcgcccatatcacatttatggtgtaacggaaatatccaatttttatccataaagcaactggaagtcatgcgatccaccaggtgccgtctgccgcctgatacaaatcgccaacttcttcagaaagcgtatttccactgaaatcttttacaataactttatagtaaagatcataattgtctgtggcacagtcatttttgccattccagccttcttccacccaggattcaaaatatattttttcatcttctataaaaagggcgctttcatgaccggttatcggaaaagaaattttctcgggataataacatacaaaggtgtcctcctgactgatgatgtgtaccggattttcaatgatgcaaagattatacaggctcacttcttctgtactaagttctgtctctttttctaaaagttttccgggaatatagcggtacagagagattttcttttcgtcataatcgccctgcagaaaatagtaaaaaccctctgcatagacaggattgctgtaaatgacatttctttttttgcaaacggtttgaaaactttaccggactcaaaatcaaaaaacagaatgactgaaccctgatatcctccggattttgactattcgatcaggtcataaaagtcattggtatccagagatttcgctttaaaaaataaaagcccctgttctgcctgtgaattccaggcaaagcaggggatatcaatttggggtattaaattactgtttttttctgtataatcactcaaaaaggacaccttttattgtataattatgttatggaacaaaacatacgaaagaaggtgtcctgaatgaaaaattagcattgaagaaactgctaacttatatgaagagtgtatataaaatcccgcaaaaaatcaagtgtttaacggacgaaagaaaaagaaaatctattccattgtttaacattgtcatgccggtactgctttttctgatgctgcagtatgaaagtttccataccattttttcatcccctgaaagcatgtcgaaaagactgaaaaactgtctgagccgaaaaaaacacacaggggaaaccgaatacttttaccggagtgtggtgtgcatgattataggtaaatcgccacacgtaattctggggcaggaaatgttaaaaccaagggatggttctgggaaagacgaaggagaactgacaggcggaaaaaggttgattgagcagctgaagaaacggcatggacattttgcggatgtgattgtggcggatgcgttatatctgaatgctccatttatcaacactctgaaggaaaatggtctggaaggggtgatacgcctgaaagacgaaagaagaatgatttttcaggatgcagagcgtctgttcaaacaggatgagggaaaaaaggcatctttctggaaagggaaaaagaagattgaagtatgggatctttctggttttaagatggaagggtgtccatataaactgcgtgtggtgcggtatcatgagcagtgggaagaaaatggaaaagaaacagagcgtttcatgtggcttgtaacgactctggaagcggcagactaccgggtcttatgggaaatgatgcaccgcaggagggacattgaggagaatggtttccatcaattgaaaacgtattatcacgcaaagcactgttactgtcgagatgcggttgaaaccatatttaatctgataatcataggctttaatgtaagagagttatatttgtaccgaagaagccggaactttgcaggaagtggtataagccgaaaaagcataaaccggattttttgcgatgatctgctaacagaaaaagtgaaacagattttatgtgaaaaaggcggatagaaaatcagcagaaaaaatatatagggaaaaagcagggggaattttgcgcgtattgaccaggaacgaagggtaaccgcagatggaatgctgataactggattatttataaaaatgcatagataaaaaagttaaaagcgaaatccctgtgtgactggcggacaggttgcataaaaagatatgtttttgtataataaaagaatgccggcaggtgaatgatatttgagtccggcatggaaattagtgataaaaacatatgcctgacaggcaaatggataaaaatcatgaaaatgaggataaacaagatgcatacacgacataaaagaggatataaatttacagataaaaaacagtcaaaaagaggaattgctgcatggatactgtcggttatatcattgggggggctaattgcagtcattgcctgttcttttcaggatggaggaaacggaagcatgtatcttgggagtgcgggtgtgtcgtccatgttcgttggagtgatcgcattgttcaatgcaattgtaagcttaagagaggaaaattcctatcgtttttttccttatcttgcgaccgtatgctctttccttgctgttggggtatgggctgcgctgtatatagttggatttttgctgtaaataaagagagaaattggtgtgaaaataagatttttacacgcaggaatggaggattcatatgacagattttgaaaaacagatttcatttatcatggaactggacaaaataaaaaagattacaagacagacgtatttaagcgatgggagcagaaaagaaaatgatgcggaacattcctggcatctggcactgatggcgtttgtgcttgccgattatgcaaatgaaccggtcgatgttttaaaaacaatgaaaatggtactgcttcacgatgtcatagaaatcgatgcgggagatacttatgcgtacgatacggagggtaataagacaaagcgggagcgtgaattaaaagcggctgaccgtatctttggtttgctgccgaaggcacagcagaaggaataccgcggtctgtgggatgagtttgaggcgatggagacaccggaatcaaagtttgcgaatatgttagataaggtacagccattgtttttaaatgatgcatcgggtggtatttcatgggaggaacatggtgtgaaaaaatctcaggtattaaagagagacgagagggtacacgagggttctgagcggatctgggagtatgcaaaatcattgattgaaaaaaatgcaaaatatggaaaactgattgatgagtgatagaaatttttgtggaggttctgacttaatgttatacaaagaattatataaagaatccaacgagcttgcaaaggagcgttttgtgctggtgcgtgagcgggttgcagagattgaagaaaagccggagacagaagaaaaatataaagaatacttcaggcagacggcacagctgctgcagaaacaggcggctgtctatgatctatgggcagatgatgcgattcaaaaacagagtttaaaagaagcagaaagatgtaatcaggcattatataaagacattcttggtgaggcatatcagacaagttatgcgaatccggattatgctgtggaacaattaggagaagagttcggacagcttctctgtgcgtaccttgcatatatcagacgtgagactggtgcggcatttcgtggggatctgatgcagcttacgatccagatggaactgtttgtcgaaatttataaccgttttgaagcaggggaagaaaaagatgtcccggagaaatcagcggtgcagcaggatctgtactggtttttccatgattacagtgagattttttatgaaaaaagtcttcgaaggctgattgatccggcagaagattttgagaatgatattgtgatgaatgctgatcttaacgatctgcgctatctgtaccgctacggtgtatatattggggaaaatgagaaaaagatggcagcatttttaaacaggatgaccgatgaggagatccaggcgatggcagacacctatacagaaggctatcggatcggatttgaagtgacaggcaaagatcttggcaaaaagcagacggtacagctccgttatccgatcggttttgagcggatggtccgtgcagcggtacacaattttgaaaaaatgaatttaaagccgaccatgcttgcatctgcaacatcaccaaacaagcagtttgactatgatcacagggaagaccgtgcactctatctggataaagcgtatgtggagcgctgcttagaggcaagaaagaattattttgaggaagagaaaaaattagcggccggtcatgcaggtcctgcagtgattgaagtatttggagaagagccgttttcaccggaaaataaagagcgtgcggtaaaatacaacgaaaaacagcagaaactctgtgtctatgagatgaacatggcagggcagatgatcaatgaatatatcaaaggcgaagagcgcagttttacaatcatcgcatacccgatcccggagattggtgaccgttttgaggagatttttgccgaaacggtaaaattaaatactttggattataaattgtaccagacgatacagcagaagattattgatgtattagatacggcagatcaggtgcatatcacgggaaaagaaaaaaataagacagatttgtatgtaaatatctggaaattaaaagatccggcaaaggagactgcatttgagaactgcgtggcagatgtcaacattccggtcggagaggtatttacttcaccggtattagagaaaaccacgggaatacttttcgtcggacaggtctacttaaacggactcaactatgagaatttagaaatccggtttaaggatggtatggtagagtcctatacctgcaccaattttaaggatgaggcagaaaataaaaaatatatccgtgataatgtattaaaacatcatgacacgctgccgatgggagagtttgcgatcggaacgaatacaaccgcataccgcatggcgagagattatcagatcgcagataaactgccgatcctgattgccgagaagaccggaccgcattttgcagtgggtgacacctgttacagtcatgaggaggacaatatttcctacaatccggatggcaaagcgattgttgcaagagaaaacagcatctctgcacagagaaaagagtctgtagagaaggcatatctgaactgccatacagatatcacgattccatatgatgagcttgacaagatcacagtgataagaaaagatggcagtacagaagatatcattgcagatggcaaatttgtcttagccggaacagagcagctgaatgagccgcttttataaaaacaggattgttaaaaataagctggagtcctgcttcagaaataaataagataatatataagataatatataagattgcttaataaataaaataataaatattaattggacttctaaaagaatgacgggtacaatacacataggtaacagtggaagtgtgaaactgtaggaatctggaaggagaacgattatggcaaaagttggtattgtaatgggcagcgattcagatatgccggttatggcaaaagctgcagatattttagataagcttggaattgattatgagatgacgatcatctccgcgcacagagagccggacgtattttttgaatatgccaagagcgcagaagcaaaaggatttaaggtgattattgcaggtgcaggaatggcagcgcatttaccgggtatgtgtgcagcaattttcccgatgcctgttattggtatcccaatgcataccacatcccttggcggaagagattctttatactcgatcgttcagatgccatccggtatcccggttgcaacagtagcgatcaatggaggtgcaaatgcaggactgcttgcagcaaagattcttgctacttcagatgaggctctgctcgcaaaattaaaagagtattcaaaagagttaaaagaacaggttcaggcaaaagatgccagattacaggaagttggttataaaaattactaaaaaacaacagattcaggaggaaaaattaatggattacaagaattccggtgtagatatcgaagcaggctacaaatcagtggaactgatgaaaaaatatgtacagggaaccatgcggccagaggttttaacaggtcttggcggattttccggtgcattttccatggaaaaatttaaaaacatggagaaacctaccttagtgtccggaacggacggcgtaggaacaaaattaaaacttgcatttcttatggacaaacatgacacgatcggaattgactgtgttgcaatgtgtgtcaacgatatcgcatgtgcaggcggtgaacctttatttttccttgattatatcgcatgtggaaaaaactatccggaaaagattgcggcaattgtaagcggtgtcgcagagggatgcaaacagtccgatgcagccctgatcggtggagagacagcagagcatccgggactgatgcctgaggacgaatatgatcttgccggattcgcagtcggtgtcgtagatgaaaaagatatcataacaggtgcagatgtaaaggcaggagatgtactgatcggtatggcatcttccggtgtgcactccaacggtttttcacttgtcagaaaaatctttgagatgacaaaagaaagcctggatacctattatgatgagttaggaaaaacacttggagaggcattgcttgctcctacaagaatctatgtaaaagcgctgcgcagcgtcaaagaggcaggtgtgcgcatcaaggcatgcagccatatcacaggcggtggtttctatgagaatgttccaagaatgctgccggagggaaaacaggctgtgatccgcaaagacagttatgaagttccgtctatctttaaactgatggcgaaaaagggacaggtagaagagaaaatgatgtacaatacctacaatatgggacttggtatggtacttgcagtagatcctgctgatgtggacaaaacaatggaagcaatcaaagcagcaggcgagacaccatatgtggttggtgagatcaaagacggtgaaaaaggagtaaccttatgctaaaactggcagtcttagtatccggtggaggaacaaatcttcaggcgatcattgatgcgatcagcgcagggaaaattacaaatgcgtgcatttcggttgtcatcagtaataatgcaaatgcctatgccctggagcgtgcgagggcacatggaatcgaagcactgtgcatctcaccgaaagattttgaaagcagagaggcttttaatcaggcattccttgataaattaaattcctacaatgtagatcttgttgtgctggcgggattccttgtagtactgccggagatgatgatcaaagaatatacgaaccgtatcgtaaatatccatccatccctgatcccatctttttgtggaaaaggattttatggtctgaaagtacatgaaggcgtgcttgcccgcggagtgaaggtgacgggcgcaacggtacattttgttgacgagggaacagacacgggaccgattattttgcagaaggcagtcgaggtagagcagggagatacaccggaagtattacagcgccgtgtgatggaacaggcagaatgggtgatccttccaaaagcgatcgacctgatcgcaaacgggaaagtatctgtggaagatggacatgtgatcattgcgaaagagtaagaaagctatcggtagaaaatggacatacgatcattacagaatagcaggaaatgaaagatagtgtttaataacagagtaaggagcgacggaggatgaaagtattagtagttggaagcggtggacgtgaacatgcgatcgtgacaagtgtggcaaagagcccgcgtgtcgataagatttactgcgctccgggaaatgccggaatcgcggcacttgcagagtgcgtgccgatcggtgccatggagtttgataaacttgtggcttttgcaaaagagcaggccattgattttacgatcgttggaatggatgatccattggtcggcggaatcgtggatgttttcgaggcggagggattaaaggtatttggaccgcgtaagaacgcagctattttagagggatctaaggcattctcaaaagacctcatgaaaaaataccatattcctacggcagcttacgaaaactttacatcagcagaagaggcgcttgcttatttagagactgcaaaaatgccgatcgtattaaaggcggacggattagcactcggtaaaggtgttttgatctgcaacaccttagaggaggcaaaagccggtgtcaaagagatcatggaggataaaaagttcggaacagctggaaataccatggttgtggaagaatttatgacaggacgtgaggtgtctgtattatctttcgtggatggaaagacgatcaagatcatgtcttctgcacaggatcacaaacgtgcgaaagacggcgatcagggattaaataccggaggaatgggtaacttttctccaagtccgttctataccaaagaggtggatgatttctgtcagaaatacatttatcaggcaaccgtggatgccatggctgcagagggcagaccgtttaccggagtcattttctttggactgatgctgacagaggatggaccgaaggtgctagagtataatgcaagattcggcgatccggaagcccaggtcgtacttccgcgtatgaaaaacgacatcattgatgtaatggaagcatgcgtagatggcagattagataccattgatctgcagtttgaggataatgcggcagtctgtgtggtactggcgtctgacggatatccggtatcctatgaaaaaggatttaagatcagtggttttgaaaagtttgatggaaaagacgactatttctgtttccatgccggaacgaaattcgatgagaatggcgatatcgtcacaaatggcggacgtgtgcttggtatcacggcgaccggagctgatttgaaggaggcgagaaagaaagcctacgaggcaaccgagtgggttgactttgccaataaatatatgcgccatgatatcggaaaagcaatcgatgaggcaaaataagagcggcattttctatttgttttttacttaacgacagggacttcggatttaaaatccgatgtgccctgttatttttgtttcatgataataaaatgtttagagaatatgtattttatgattttgggatagacttttgcagatcatgatgatatattgtcggcaatgcccctgactggaaaggagattaaatggtcaggaaacgctttaaatgatgcagaaacttgaaaatacactgtcacctccgtataataaataaagtatgtacagcacttagaatatgtatcgtacataaaacatgttctatgccaaaagtaaaattgataaaaacggaggacacatcaatgaccagaaaagaaaaagcaatcgaattacacgataaaggattcaactgtgcccaggcagttgcctgtgcatttgcagaggagaccggcataccggaagaaaccttatttgcagcctgtgaaggattcggacttggcatgggcggcatggcagcaacctgtggtgcggtatccggcgcagtcatgcttgcgggattaaaaaacagttgcaaaaatttagagcagccggcaagtaaggcagatacctataaactgaccagagagatcacgaagacatttttagagaaaaacggatcgctcacctgtggagaattaaagggcgttgcaaccggaaaagtacttagaagctgcccggactgtatccgtgatgcagtggagatagcagagaatattttagaactttaaagcgacagaatgacgttgaaaaaacatgaaataatttactgttatgtcaaaatacacaacgaaataaaacgaaaatcaaataaaaatgataaaatgcacaaataaaaagaagaatttttaagaaagacagaagaatattgtatgtttatccaatcctcctgttggtataatgcacttgtaacaaacaaagagttacaaatacattaaatcaaatgggaggatttttctatgaaaagaaaggtagttagtgtaattttagcaacagcaatggtagcatctatggtagcaggatgtggcggaagcaataacgcatccacaaacaatgccggaacaacaaccgatgcagcagcaagcgatgcatcaagtgatacatcgaatgatgcagcagctacagaggcagccgatgcaggggacgcagcagccgatgcagcaacagacgcagatgcaagtttagcagacaaaaaagttggtgtatgtatttaccagttctccgataacttcatgacactgttccgtacagagcttgaaaattatctggtagaaaaaggattttcaaaagacaatatcacaattgttgatggtgcaaacgatcaggctacacagacaggtcagattgataactttatcacagagggggtagatgtccttattatcaacccggttaactcctcttccgcagcaaccatcacagataaagtagttgcagcaggaatcccgctggtatacatcaaccgtgagccggatgaagaagagcagaagagatggtcagataacaactgggatgttacatacgttggatgtgatgcacgtcagtccggtactttccagggtgagatgatcagtgatcttggtcttgataccgtagatttaaatggaaacggtaaaatcgactacgttatggtagaaggtgatccggagaacgtggatgcccagtatcgtacagaatattctgtaaaagctcttgaggatgcaggacttgaagtaaactgcttatccgatcaggttggtaactggcagcaggatcaggcacagcagatcgtagcgaatgctcttggacagtatggcaacgatgtagaagttgtattctgtaacaacgatgcaatggcacttggtgctttacaggcaatccagagtgcaggacgtaccgtaggtactgatatttatctggtaggtgttgatgcattatcagaggcattagaggatgttcttgcaggaaccatgacaggtactgtatttaacgatcacttctcacagtcccacagtgcagcagatgcagctatcaactacatcacaggcgctggcaatgatcactacatcggatgtgattatgtaaaagtaacaaaagacaatgcacaggatgttcttgacatggttaaataatctgtaaaaagaacagggtataaaagtggtgcgggtgcatatggcacccgctgccactattcataagaattatgatcagactgcagaaatgcagaaatgaatgtatgaaataaaaacaggcagatatatattctatgaaaaatgaagtgtgctaaatagcacagatatgaaataggaacataattggcagagaagtaagccaaatgatataaaggaggagaaacatggctgagtataaactggagcttaggggtgtatgcaaatctttccccggtgtcaaagcacttgacaatgtacagttatcactccgtccgggaaccgtccatgcactgatgggggaaaatggtgcaggaaaatcaaccctgatgaaatgtctgtttggtatttataaaatggatgccggcgagattattctggacggagaaaaagtcgagattaataacccggatgaggcaatgaaaaaaggaattgccatggtacatcaggaactgcagccggtaccggcaagaagcgttgcagaaaatatgtacctgggaagattcccgacaaagtgtggaccattaaaagtgatcgatcataagaaaatgtatgaggatactgcaaaatggttaaaagaagtaaaaatggactttgatccgaaagcacagcttggatctttatccataggtcagatgcagtccgttgagattgcaaaggcagtttcccaacaggcaaaggttatcatctttgatgagccgacatcatctctttctgataatgaagtagaagcattgttccgcatcatgaatgatttaagagacaaaggtgtggcaatggtctacatttcacataagatggatgagatcaaacgaatcgctgatgatatcacagtcatgcgggatggtacatatgttggaacctggccggcagcagagatgaccacagatcagatcatcacaaagatggttggccgtgagctgacaaatgtatatccaccgagagaaaacaaaccgggtgatgaagtggttatggaagtaaaaaatctttgctccatccatgcaaaatcattccagaatgtaagttttcagctccacaaaggagaaatccttggatttggtggactggtaggtgcacagagaacagaattgatggaaggaatcttcggtatccgtggtattgcatccggtgagatctatatgcatggcaaaaaagtaaagatcaaacatccaatcgatgcgatgaatgccggaatcggactgatcactgaggatcgaagaggaaacggtattttcggatgcctgtctatcaaagataatgtaggtgtatctatctacaataaatatctgaatgcaggatttgttttaaatcacaaaaagatcaatgagatcgtaacaagcagcattaaaaaattaagtatcaagactccgagcatgaaagaacatatttccaatctgtccggaggtaaccagcagaaagtaatcgttgcaagatggttagccaatgacccggatgttctgatcatggatgaacctacccgtggtatcgacgtaggtgcaaaacatgagatttatgagatcatgtgcgacctggcaaaacagggcaaagcgatcattatgatttcttccgagatgtcagaacttcttggaatgtcagacagaatttgtgttatgtgtaacggaaaactgaccggtgaagtgaaggaaccggaagatatgacacaggcaaaaattatggaatacgcaacaagattctgatgcgataggaggagacgaaaatgggaaagacaaaacagcagaaagtaaaagattttttgattaacaacggggttattattgtaatgttcattctggtaatctatactggtttgacatccaataacttcttcacaggcaacaacttaatgaatattcttatgaatatgagttcacgacttgtcattgcacttggtattgcaggatgtgttatcaccgcaggatgtgacctttccgcaggacgtatgattggtttcggtgcatgtatttccggtatgttgttacagcgtctggattattccggtaaattcttcccggatatgaaaccattgaacgtagttttagtagcgatcatcgcaatgctcatctgtgcagcatttggtacagtaaccggtatctttattgcatacttaaatgtaccgcctttcattgcaaccttagcaatgatggaaatcgtttatggtattggacttatcgttacaaacgcaacacctcttggtggatatgttgaggcatataccaatgttgcaaacaaaaaatttctcggaatcaactacctgatctggattgcaattattgtggcagcgatcacatggttcattttcaacatgacacgtcatggaaaatatatgtacgcaatcggtggtaacccacaggcagcagaggttgcaggtgttccggtgaaaaagacattgatcttaatctacatgaaagcagcagctatgtatggtcttgcaggattcatgctcggcgcaaaagcaggtggtgcatctgttcagaccgggtatggttacgaaatggaagcaatcgcagcatgtacgatcggtggtgtatccgtaacaggtggtcgtggtaaagtttcatccgctatcatcggtgttgcagtattcgagttattgaaggttgctctccagtacttaggaatgaatgcaaacgcacagtacatcgcaatcggtgttgtaatcttcgtagcaatttctctggatatcagaaaatatatagcaagaaaataaaacatacggtataattcttatatcggactgtaaaataacggctgggtgttacagaccagccgttatttttgcttagtaaaacaatggaggaaaacaaggattatatgacaacagatcagattttagagacagcagggataccattacttttatttgtgattttgatctattatggaatgcggttatggtttatgaaagatatctccgccatccgaggaaagaataaaccaccggtaaaagacgaagaaaactatgcaaaatacgccggaaagctgatgttcttttttgcagtggcaacacttgtcatgatgcttttattattctggaacacctatgtggcagtggcagagatcattatctgtacggtgatcctcggaattttatggcataatatgaatgcaaaatatggagactagcggaagaaaatgtgaaaatatgattttttcatattggaatggagaatagaacacgatgaatttatattcggtattattggtggatgatgaggaagaagtatattctgtcattatgaaaaagcttgactgggaagcgatggggtttcgtattgccgggtatgccagaaatggcgtcgaagcattagagatggcagaggaaatccagccggatgttgtgatgacagacatcaaaatgccatacatggacggactgaccttaagcaagaaattaaaagaactatatcagaaaataaaaattattattttttctggatttgatgaatttgaatatgcaaaagaggcaattaagatcgaggcggaggagtacattttaaagccgatcaattccaatgaactgcgggaagtgtttgagcgtatcaggacaaaccttgacagagagcttgatgaaaaacgtaatatcgaaaaactgcgcgcttattatatggagagtcttccggtattgcaggaaaacttttatacatcattgattgagggaagaattccggcatctgagattgaaaaatatttgaaacaataccagataccgtggagcggaccatattatgtggcaactatattacatatcagcacgccggatccacagcttgaactcgatccgtttttgcttggaatgtccgtcaaacagcttgctgaggaacagtttgtggacaagtggagatcgaacacattcttttatctcggagacatccttgtgatcacacagttaaaagaaacggaagaaatcacggcatataccaatgcaatggatcggttttgcaagctggcgaaacgtgtctgcggtgcgaaggtgacggcaggaatcggtccggtctgtgatgagatcgcagagctgccggcttcctatcagggggcgcgcaatgcggtttcctaccgtgtgatctatggaaatacaagagccattaatattgcggagatcgatccgcagggcagtgcagaggaaccgtgggaagagcagtcgatcgggaatattttaaaaaagattaagaccggggatgagcaggcgctgaaagaagcagtcaaagaaagcgtgacacagctttccggacgtggagcatcactgcagaaatatcagatatttatcacggaacttattgcggaaatcttccgttttggaacattaaacgggctgaatctggacgaaattttcagtggtacgggagatatctaccgggaagttcttcagatggaatcgccggaggcactggaaaactggctgctaaagaccggacgtcagatgcaggagatgatccagaatggcagacaggacacgacgaaatcatttgtcacaaaagcgatcgagtatgtcagggaacactatgcagattcaggactcaatgtggagagtgtatgtaaaaatctttcggtcagcacggcgtacttttctaccgtgtttaaaaaggagaccggaaaaacttttatcaattatctgacagagtatcggatggaacaggcgcttgatctgcttttgaatcaggatgaaaaaacatatgtgattgcagaaaaagtgggctattctgatccgaattatttcagttacgcatttaaaaaacagtttggaatgtcaccttcaaagtacaaagcagaaaaaagaaaatgagtttgtcaaatatcaaagataaaataagagaattaactgcatatatcaggaaaatgacaaaaccgcacagtattcagatgacgatatcgatttcgtttacgattctgtccatatgtagtatggcctttcttggcgtcacactttaccggcagttttcaaacagagcagaagcgatgacgattgagagtacggggcagcttttaaatcagacagccatcaaccttgaggattatctccgaaacatgcgccgtatttctgatactatgtattacagtgtcatcaagaataaagatcttgccagtgataccatggatgaagaaatgaatctcttatatgaggcgaataaagataacctgatcagtattgcctgttatacgggagagggacagcttgtggcagcagtacctgttgcgaatgaaaaaagtcaggtaaatattgtgaagcagcagtggtttaccgatgcggtcggtcagatggaaaaccttcatttttcgacaccgcatgtgcagaatctgtttggcgatccatcttaccgttattactgggtcgtatccttaagccgtgccgtggagctgacaagtaatggaacatcgacgctgggagtacttttggtcgatatgaactacaacagtattgaacagatcttaaaaaaagcgaatgttggaaattcttcggagtatgtttacctgatcgacggaaagggtgagatcatttatcatccgagacagaagctgatctataccgatctttatcaggagaataatatcgaggcagcagggtacgaggatggaagcacggaagagattttccagggggaaaaacgccttgttacggtaaagacggtcagttataccggatggaagatcgtcagtgttgtgccaatgagttcctttgatatgggaatgacaggcacaaaatattttgtgatcatgctagtgacagtatctatgcttgcggtgatccttttaaatcagcttgtgtctgcaagtattgccatgccgctgaaaaaattaaataattcggtcaaggagtgggagaccggaaatatgaacccgtctatctatatcggcggatctatggaagtggaacatttagggtgtacactccgttccacggtggaacagatcaggcagctgatgcaggatattgtggtcgagcaggaagaaaaaagaaaaagtgaactcgatgcgcttcagtcgcagatcaaccctcattttttgtataatacacttgactcgatcgtctggatgatcgagggagaacggtatgaggatgcggtatttatgatcacacagttagcgagtcttttccgtatcagtttaagcaggggaaaaacagtcatcagtgtggaagatgagctgaaacatgccagaaactatatgaatatccagaaagtacgctataaaaatatttttgaggtacggtttgatatagatccggagatcctgcagtgctgtacggtaaaactggtggtgcagccgctgcttgaaaatgcgatttattatggcgtggaatgtatggatggagacggagaaattgatgtcaatggatatcgcagggaagatgatatctatattgaggtcagagataacggacttggaataccggaagatgaagtggaacagcttttgaaggaaaataaccgtgtacacaaacgtggatctggtgtgggacttttgaatgtacataaccggatcaggctgcgtttcggtgaggaatatggtctggagatagaaagcgagccggatgagggaaccacagtcagaatccatttgccgtatatcgtctatacgccggaggagcaggaacggttagagtcagggagaaaacaactatgaagcggaccggaaaaaataatttgatctatttaatggcattgattttagtgatcattgcatttattgcgtttgcgacatatgggatgcttgatggcagcaaggatgaggaatggtatccggtatccgtgatcgtagaaaacagcagcagtgacagatttacatcttttcgggaaggacttgaacgaggagcggaagattatcatatccgtttaaatgtggtttcgacaggcgcattttccggtattgaggaagagtaccagatcattcacagggagatcgataatggagcaaagggcgtgatcgttgaaatgtgtgacagcagcaattatacggatgattctgctgtggaaatcggttctgataagatgattctggtggaaacggatgtggaagctgagggaatgtatgcagcaattctgccgcagtcttatgagatgggggaggcagttgccgaagctgttattgcggattatggggaaaagcttgaagatacggacattgggattcttgccggtaacttaaaacagactgccggacagcagtgcctgaaaggttttatggacaaaatagagtctgccggggcatccattttatggaatctgtctgatgaagacaatgtaaataatacatttgaatggtgccttgagaaaaagagggtagacatcgtggtatcattagataatgacagaacggaacaggctgttgattatctgcaggcgcaggaacagacagaatttggactgtatggaattggctgctcagaaaaaaatgtgtattatctggataagggtgtgataggagcgttggtcgtaccgaatgagttcaatatcggatatttaagtgcggcagcgatcgcgggtcagctgcgcgagccgttatcttcggcaaaaacagaaaaagtcgggtttcttacgatcacaaaagataatctgtatgacgaggaaaatcagaaaattttatttcctatcgtgcagtgatatacaaatggggggtagatgtaaatgtgtggagcagaaaaagtccggcacatgttgatgggggaacaagtcttgaagaaatggaaaaaaagtaaaaaaatgaccgtggcttttggtggaattttagtcatgagtgtggtaattggcggctgcggcggcagggaagatgccaaaaagagcattaagatcggcatatctgtttatgatcagtatgatacatttgtatcagaaatgatgaaagattttaatgattatgcgacaaaaaaagaagaagagacgggtgttgcgatcaatatcgacacttacaatgcatcggcaagccagtcgacgcagaacagtcaggttgaaaacatgatcacggagggatgcgatgtgatctgtgtcaatctggtggacaggacggatcctaccgcaatcattgatcttgcggaaaaaaacaatattccggttatttttttcaatcgcgaactggtggaggaagatttagagcgctggacgaggctttattatgtcggagcgcaggcatttgagtccggtatcatgcagggagagcttgcagcggaagcatttctgaccgatcagtcactggataaaaacggagacgggatttttcagtatgtggtgttggagggcgaagccggtcatcaggatgcaattgtccgtacggaatattcggtcagcacaatgatcgacagtggagtggaagtagaaaagctgggatatgcgatcgcaaactggaaccgtgcacaggcgcagacgaaaatggcacagcttatgtcacagtttggtgacagcattgagctggtcattgccaataatgatgatatggcgctaggtgcgatcgatgcgctcaaagcgtccgatcttacaaaggatgaatggccggcggtcattggaatcgatgggactgatgtaggattagaggcggtcaagaataaagagatgatcggaacggtctataatgataaagaaggccaggcagatgcaatgttaaatcttgcatatgagctttccaccggaggtgatctgtcggatctgaatctgatcgatggaaaatatatccgtctgccttatgcgagagtgacctgtgatgatgtggattcgtacatggaaggagatacagagtaaatgcttttgaataatgaaaacgtggactatctttcggaatggcccgcccattattatgagattgaggatattaatgaacgtgaacgtattctgcagcttgcaatcgagcagaagttagatccggcattggatgaaaaacgccttttgattttaagaaagcgctttggagatcatccggcagaaaaacgtgcggatcattttctgcgcgcatggatgatgatacaggcagccagtgcaggtggtgtatccttttttcagaaaaaaagacagaaaaaagaactttgtggatatcttatgcagctcggtatccggacagatgagaaacaaaatgtggaaaaggatgctgatgtggaagatgtttgtggatatatacttgaggaagagtggaaaaattttgcatatacctatctggcatcctgtaccggaagcagggcgtactgctccacattgtttggtatcgtgccgatcaaagatgcagcagttgcagaaaagatcgcacaggacattgatcttgtgacgaaagattacccggcagcattcggactcgaagaggcggtccgcccgttccgcagtattatggtggatgcattctgccagtatattccaaatggggaatcagtctggaaatcgatgcatgaataaaaaatgtctgaacggccatctttgatgggaaacactggacttttttttcatatcatagtatagtaaagcatgttgaaccttgaaaattgaataaaaagtatattatttttatgttcagatacgcggtctttgcgcccgtataccggatacataaatgtgacagcagatctgccggaaggatatgcagtctgttgtctccttattagcgccatgcacctgtggaaaatgcataggaaggttctgtgaacagacattgtgatatgttcaggaattacctgtgtttcaatcagcaggttaacgaggaggagagtgatcgaagattcggcggatgctctcccgtacactcccggtgcgagatataccggcaaatatgcaggtgactgcaaaacaaatacggtataagggagaagataacctgaaaaatatttttgctgtcagaagaggatcttctgacagtggaactggtcagggaaaatgagtgtaccggcgggattgtgccggaaacagttgatagatagaaaagaggaaaatttatgtgtggaattattggttatacaggtagtgaagatgtaaaaggagtgttacttgatgcgttagagcttcttgagtaccgcggatatgacagtgcgggaattgctgtggcagataccggcctgaaacagacgaaagtttataaatgtgcgggaagagtaaaagatttaagagccatctgtgagtcagaaaaactgatcacagagtgtggaattggtcataccagatgggcaacacacggcggtgtcaatgatacaaacgcacatccgcatcaggttggaaaagtgactctggtacacaatggcatcattgaaaattacagagagctgatcgccgactatgaactggaaagtgttttaaaatcagagacagacagtgaggttgtggctgcacttttaaataagttttatacaggtgatccggatgaagccatcaaaaagacagtttccaaattaaaaggaacatttgcattagtgatcttatttgaagatcatcagggtgagatctattctgccagaaatgtcagcccgatcgtcgcaacactttgcaaagagggggctatgcttgcatccgacctgacagcactctgccgttttaccaaccgctattttgttgttccggagtatcatattttaaaactggcaaaagatgccattgtcttaaaagatttcaatggcaatcaggtggagccggactatcttgaagtagactgggaacttaataatgccggaaagaacggttatccgttttatatggaaaaagagatcatggaacagccggatgcgatcgagcgtacaatcacaaaccgcatcacaagtggaatgccggactttacggcagacggtgtgccggatgagatctttacacagtgtgagcgtgtcaacattatcgcatgtggaactgctatgcatgccggtcttgtggcacaggcactgataaagtcgattcttcatatgcacatcgatgtcgatatggcatccgagtttatgtattcggatccggtcatcgatgagaaatcattagtcatcgcagtttcacagtccggtgagacgatcgataccttagaggcagtcaagtatgcaaaaaaacgtggagcgaaatgtttatccatcatcaacgtaaaaggatcttccattgcgcgtgagagtgattatgtgctctataccaacgcaggaccggagatcgccgttgcaagtaccaaggcatacacgacacagcttgctgtattttatctgatcgtggcaaaaatggcacagcttcgcggtgtcttttcacaggaagagacacagagttttatccgtgagctgcagcgcacgccggatgtcatgaaaaaagtgttagagggacggcaggagatccataaacttgccaacaaggtgttagaggcgaaagatctgtttatgatcggccgtggacttgattactctattttgttagagggttctctgaagttaaaggaggtatcctacattcattctgaggcgtatgcgtccggcgaattaaaacacggaccgatcgcactcatcacgcaggatacgccggtcgttgcagcagtgacacaggaaaaattaatgtcaaaagagctgtcaaatatcaaggaggtacggtcaagaggtgcggacatcgtgctctttatcaaggaaagtcttgcaaaagatatcgaccgtgcatatgataccttccatctgccggatatgcaggatgaatttatggtaatgccggcatccgtggcactgcagttacttgcttattatgtttcttccgacaagggatttgacgtggataagccaagaaacttggcgaaagtagtgacggtggaataagagaagcaaaataaaaagatatgtggaaaagtgtccggaaaggggaaaaagaccgcgtatctgagcataaaaaaagattgggggaagccgcacaaagtatttggtgtgactgcccccatttgcatttagaccagttccgcgatgcgcgacactgccacataaatttcagaaattttataccaggtacggtagtcaatgacgccggtgaccggcagaccgaagacacgctggaagacctcgacagcctctcttgtggcaggtccgtagattccgtccggtgtaactgtcggaatcgccggataggatcttgaaatccgtgcaagttcctcctggatctgacgcactttttcgccggtcgaaccgatcgtaaggtcgactctcggccaggaagccgggatgccggatacttcttctgccgtgttgatgtacatgttgtttccataatagtagcgcagaatttcgattgcctcatagttctggtcacccaggtatttgctgccccactgactcagccagttgctgcaggtcacacgttccccatcgcagtactgcgttaagattggctggctgacgtttggccgggataaaaagttctggaacatttcatccacgatgtcggagatgctctggaaaatgttcctgccgtaggtaaatttctggtcgtaggcggtggaggaggtgatcgtgaaactgtagcctttgttccggtaccactccgtgtacacccggtttaatgtaaatgacatgattgcaaggatatttgcgcgcagcgtcgcatccggccaggtggaatagatttcgctggacgctacatttttgatgtaatccttgtatcgcacataataatcgcgcgcagtcgtatcgtttggcggaccgtcatgtaccacgacatattccggcaccacgactctgcttaggacgatctccccggtctcggagatcggcttgatctcagactctgcgattttcggtggaaaatcgccccagagggtattgaccgggatcacgatcgtgtctaccgggttccccggtgcatccacctcatccattcgtacttcctgaagcgacagctgcttcgaaaacagttcaattcccgacacagtaaacgggcggaatccttcagcatcgacctgaatactatactgcgagaacggctgctcttcgcctggctccattgagaattcaagcggaggcgcaggaagcgtaatttgttcggacataccggatgcatctgtattcacctcctcaacgacactgtccggatcaccggaataggagatcgctacacgggcgtttgtgatcggacggttacttcttcttgccgttacctggatctttaactcaccctgatcggtattattttgtgtataggcaatatctgacatgaaaaacctcgtagattcattcattctattatatgatgcagtctgtcaaaaggtgtgtttaaattgtttgtgtgaattataaaataatggaaggaaaaatgtggtttatgatttgtcaattaacgaaaacagaggtataataattataattgatgtactgccacaggaaaactatctgtggcattattttttccgaaaatcagatataaggtaacagagatatatggcaaattataaaatgatcttacaatatgacggaacacgttaccgcgggtggcaggtgcttccggcggaacttacgatacagggaaagttacaggatgttttgagcaaaatggcaggataccaggtggaagttaccggttccggcagaacagatgcaggcgtgcatgcaaaaggacagacggctaattttcatctgagagaggaatgggatgaggataaaattttattttatctgaatcagtaccttccggaagatattgcggtctgtgaagtaaagagagtggatgagcgtttccacagcagatatcaggcagtggaaaagacctatctttaccggatccatacaggaaaaataccggaggtattcgagcgcagatatgtttatgattatacggaaccgcttgatgtaaaccgcatgagaaaagcggcagagtacctgtgtggaacacatgattttaaatcattctgcggcaataaaaaaatgaagaaatccacggttcggacgatttcccggatacagatcaaagaactgccgggagagatacagatctattataccggaaatggatttttacagaatatggtgcgcattttaaccggtacactgatcgagatcggagatggaagaagaactccggaggatgtgtcagagatcttagaggcaaaaaacagggaaagagcaggatacacggcaccggcatgcgggctgacattgcttgaggtaatatatggaaaaatggtttgtaataaataaaggcgctgattttgcaggaattgcaaaacgttttgggataagtccggttacggcaaggctgatccggaatcgtgaggttatgggggatgaggcaatcgcaagatacttaaaaggcggaattggggaactttacgatcctcatttacttttggattcggaccggttgacggatatattggtgcagaagatcagtgaacagaaaaagatcagggtcataggcgactacgatattgatggggtaatgtcgacttatattctgtacaaaggaatcacacgctgcggtggcagtgtggattttcagataccggaccggatgaaagatggttacggaatcaacgatcatctgattgagcaggcagatgaggcgggaattgatacgatcattacctgtgataatggaattgcagcgataggcgagatcgcgcacgctaaaagtcttggaatgacagttcttgtcacagaccatcatgaaataccatatacggaggagaggggagaacgccattataaaagaagtgaggcggatgccattgtaaatccaaagcagatggagtgtacatatccgtataaaaatctctgcggtgctgcagttgcctggaaagtgatacagatcctctatgaaaaatgtgacattgcggtggaggagtcctacgattttttggaaaatgtggcatttgcgacggtcggggatgtgatggatctgacggatgagaacagaatcctggtaagggaaggattaaagcggatccatacgaccatgaatccggggatgcgcgcattgattttacagaataaattagagccggaacagatcagttcctatcatttcggatttgtgttaggaccatgcatcaatgcaagcggacgattagagacagcgaaaattgccttaaatcttttcctgcaggaggacgtaaaaaaagcatcggagatcgcagcggaactggtcgatctgaatgcgcagcgaaaagacatgactgcagagggcgtagaacttgccatgcagcaggtggaagagggaaatacgggtgaaaaagtcctggttgtctatctgccggatgtgcatgaaagtcttgcaggaatcattgcaggaagaatccgggaggcgtgtcataaaccgacttttgtgctgacaaagagtgaggatggggttaaaggctccgggcgctcaatcgaggcatattcgatgtatgaggaactgtgcaaatgtcaggaattatttacaaaatttggcggtcatccgatggcagcaggactttccctgccggaagcaaatgtagagattttcagggagaaaataaatgcctgctgtggcttgacagaagaagattttattcctaagataaaaatagatattcccatgcccgtcgattatccggacattccgctggtaaatgaactgttgttgttagaaccattcgggaaagcaaatgtaaaacctcagtttgcggataagaatcttggaatcgatcgtgcggtggtagtcgggaaaaatcagaatgtattaaaactgacacttaagactgaacgtggaaaatccatatctgctgtttattttggagatgtggaggaattccgggaatattatggaagaaaatatggggaaaatgaagtgcagcaggcattccttggcaggacaaatggaatccggatgtctgtggtatattatcccgagataaacaggtatcagggaaatgaaagcatacagattgtgataaagaattatcagtaaatggaggacatatatgtttggtggaaagaaagagaaggcactgcaggacgaactctatacgatcaagaaacagattgcagaatacagtgatgaattaaaagaagattctgtgcagatgacagcatcccgtgtccagatggaagaaaatatagaaattcttgaggaaaagttagaatgtgtgggtgaattggcagaagagagctgcagaacaggaaaagaactgtacagtacattcgttgaagtacataatgctgtggaatcttttgaggcaaatcattccatttttattggacaggtggcagagcagaatgaaaagatcaaagaagtttttgaacagcacaaggcgttaaaagaaccgtgtgcacagttagaagaaagtctttaccgtgcttcgaaagagcaggatggtcttggaaatgtgacagctgaactggaagatgatgcaaaaaatatgggagtgcttgcattgaatgcggcaatcgaagcagcaagaatgggagagaatggagaaaaattccttcatgctgcggaggagatcaaaaatgtggcacagcggtatgaagaaagactaaaggcattatcagaacagatcgacgcgatggaagaggcgcaaaaagaaatcaaagaacagactgcacagatcaatgaaatgcaggcgggtattacatcgatggtaatgaaactgtacagtgacagtgcacagaaactttccatatatgaaaatggacagacttctttaagggagcacatgtccggcaacgcagtaccggctgcggattttataaaacaggccggggaggatttcttaaaactcggggatgaggcaaaagtgcaggttacagcactgcgtgaagaaatcaatgcaaaaaaatctgctgaggatgaattggaaaagatctataatggatgtaaagcacttttggatatggagtaagtaatctgtaatgaaatatctgcatgcaaaacagtcagcggcatagtaaagagcagtatagaaatgagggaagaacttatatggcaaaagaagaacagatgacgtatttatctgcgaatggaacgacaaagatccatgcggtaaaatggatgccggaggatggaaagtataaggcaattttacagatcacgcacggcatgatcgaatatattgaaagatatcatgagttcgcagagtacctgacagagcgcggatttatggttgttggccacgatcatttagggcatggcgcttcggtaaaagatgaaacagagtggggatattttgcagaaaatccgagtgatacgcttgttgcggatatgcatagcctgcgaacaacagttcagggagagaatccggggataccgtattttatgatgggacacagcatgggttcttatatgctgcgaaaatatctgtgtctgcatggtgaaaatttaagtggagcggtcattatgggaactgggtgtgtgccggatggcaccatgaaatttggtatgacgctgtgtaaatttttagcctttttccgtggctggaattacagaagtaaactggtgcagaaactttcctacagcaagccataccacaaatttgacctttatggaaaagattataccaacagctggctgacaaaggatgtggagcatgtcaaaaaatattacagtgatccacgctgcacgtttctgtttacattaaacgggtactatgggctgatggaagcggtatattttgacaatcagatggataatataaaaaaagtgccgaaagatctgccggttttcatggtttccggggcagatgacccggttggtgacctcggtgaaggggtaaaaaaagtttatcatatgtacaaagatgcgggtgtggatgatctgacctaccgtttgtatgagacagaccgtcatgagatattaaatgagacagaccgcgatcaggtttatgcggatatctgtgcatggatgagtgtcagaattgcgcagatataaaatataagatagatttacctgcataaaatataaagcagggatggacagtgttagtgaggattattatgagaaacaaaaaagtagttaaaatattatgtgtgatacttgcagcagcgatgcctgtttcctccggtgtgggtgtgcaggcagcacaggcaggggcagttgcagcgacggcagatcagacagatgatgtgcagaatgcagcagaaacttcggcagaggattctgcgcagaatgcagatagtgacgatctggaaggttccattcagtatttggatgattcggctcagacaaacaattctgatgcacagcaggatggaaatatatcgtcggatcagacgccacagcaggatggaaatgcgacatcagaccaggcgtcacaggatatcagcggaacgattgtgcaaaacgaggacagcgataatgtcacaatcaaggcaagtgataaaccgtaccttgcgcttggagcagatcttaatgattctcaaagagcgacgattctttctattatgggcattgatgcggcaaatctgtcaaattatgatgtggtctatgtgacaaatgcagaggaacaccagtatttagattcctatatttcatcctcgcagattggaacaagatcgctttcttctgttgtgatcgtacagagggataagggaagcggattaaacatttccacaacaaatattaattattgtaccgttggtatgtataaaaatgcgctgactactgcaggggtaacagatgcagatattattgtagcaggaccaactccaatttccggaacggcggctttagtaggcgtattaaaagcatatcaggagatgacaggaaaagagatcagtgattcggtagttgatacggcactcaatgaacttgtgctgaccggtcagttagaagattccttaaaaggtgtctccgacgcagaagtggaagagtttattgcgtatatcaaggcactgatcgctaaagatgatctgacagatgatgcgggaatcaacggcgcaatcgatgaggcgtgtgaaaaatatggtgtgacgttatcggatgatgagcgtcagcagatcatagatctgatcaagaagatcaattcactcggaattgatttaaacggacttgtggattatgcggagtctttgtacaattcgtttaaaaacggagatggaagttcaaatagcggtatagcagcggctgtcggtggattttttaaatcgatcatttcttctgtgggagatttctttaaaaagttattttcataataaatatataacgaaaagaggaagcgtatgttagagagaaaaagaaagttagattgtgcaaatggacgtgaaaaagcagatctcgtattgaaaaacggaaatgtgctgaatgtctttacggaggaagtgttaaaagcggatgttgcgatctgcggggacacgatcgtaggcgtaggtgaatacgagggaaaagaagaaatcgactgtaccgggaaatatctggtgccgggctttatcgatgcgcatatgcatattgaatcctgtatggcagcaccgggagaacttgccaaagtccttgcgaaggcgggaacaacgacgatcattgccgatccgcacgagatcgtgaatgtcagcggaacaaaaggaatggactatttcttaaaatgtgctgcaaaacttctggtaaacgtattttttatggtgccttccgcagttcctgcaacggatgtggagacaaacggctgtggtgaatttcttgcctctgacatgatgaaatatgtggataatgcaagagtacttggactcggtgagaccatgcgttttatggagtgctgtgagggtgaaaagagaatggcagacaagttagagctgtttgccaagaaacatattgatgggcatgcgcctggaatccgaggaaaagaagtgcaggcataccgtcttgccggtgtggaaaacgatcatgagtgttctaccgctgaggaagtgctcgataaactccgtgccggactgcatatctatgtgcgcgagggaagtggtgcaaagaatttagagacactgatcaaaacaatgttagatgcaggtgtatgcttagaccgctgtgctttctgtacggatgacaagcatgtggaggagatccgcaaagagggacatatcagtacctgcatccgcaaggcgattgcacttggcgtgccggttgcaaaagcctataagatgggaagttatcaggcggcagagttttatggattgaaaaattatggtgcgatcggtgcgggttaccgtgcagacatcgtatttttagatgatttagagcaggtcagaccgcttgatgtcatgaaggacggacgtattctgacagaggaagattatgcgaaagattattccgttccggttccggatgagctgcttcataccgttcatgtgggagaggtcaccaaagagaaaatcaggctttcctgtgatggaaaaacggatgtgatacagatgaacccgcaccagatcgtgaccacgcatctggtggaggaagtgccgacagaaaacggatatttcaaatcggatggtgtatacaacaagatctgcgtggtagagcgtcatggaaagacaggggggatcggtgttgcgccgctgaaagggtttggcgtcaaaggcggcgcagtggcgacttccgttgcacatgattcccataacctgatcgttgcgggcgataatgatgaggatatccttgcagcaatcaaaggtgtggaagaaaatcagggcggatatgttatcgcttccggtggaaaagtcgtggatgtgcttccgcttccaatctgcggtctgatgagcgaaaaatcctgtgatgagatcacggaaaaagtggcggacatgttggagaaagcaaagaaacttggcatttccgaggacatcgatccatttatcacgctttcctttatggcacttacggtaataccggagatccgtgtgacagagcgcggcgtgtatctgtttggtgcgaaatagtaaggcagttataattttttgtatatgaaaaaagagatatgatatcgaaaagtgtaccgaccccaaaagttagacctaaaaatctaacgattggaggccggtatttttattgctttatttgtttcatataaattcaatgaaatctcaatatcttgtaatctttagaattccttaataatattttccataaaataaatgttgacaaattatattatatgaaatatagtattaataagaaaataatattaaaacagatagaatattataaagaaaaggagatgagcgtatggtatttaatacaggagccgctctcttagacgcaatcgtgttagctgttgtgtcgaaagaggaggaaggcacctatggctataaaatcacacaggatgtacgaaaagccattgatgtatcagagtccactttgtatccggtgctcaggagactgcagaaagacggatgccttgaggtatatgacagagagtgcggaggcaggaacaggcgttattataagatcacggaaccggggcaggataagttagttgaataccggagagaatgggaagattattccatgaaaatatcagcattattttcaggagaggagctttagaggttatgaaaagagaagaatttttaaaacagttagaacagcttctggatggaatatcagaagaagaaaaagcggatgcgcttgcgttttaccgcagttattttgaagatgcgggcgaggaaaatgaggaatccgtcatagcggagcttgaatcaccggagaaggttgcccagagcatcaaaaaaaatcttggcatggaaaaagagaatggatcttatggcatgccggcggatcaaaatccggagtggaataagaacgatgatatgtttgtgaaaagcgaagaggtgccaaaagaaaagaaaggtggatggagtgcagcagcaatcgtagtggtagttcttacatcaccgttctggctgacattgcttttagtcgtggcatcacttcttcttgcggttgttgcgatattgtttggcattgcggttgcagtggttgcagtgatggcatcacttgtgtttgcaggtttccttttgattggttttggattcagcactttatttaccggtggagtggctgtcgggcttggactgaccggagcaggacttttggtattgggactcggaatccttgcagtacttctggtcgtgtgggtgtctggcgtattccttccatgggcagtcaggggaatcatcggtttgtgtaaaaaaccgtttgaaaagaagaaagaaagtggggtggcagcatgaaaaaatttacaaaaattatgttaatcattgcagtgtcattgcttggtgcaggactgatcttctgcggtgtcagtactgcgatgggggcttctgtatggcgtatggcaaagaatggagaactccggtatggaaactggcatattggtccggtgggactttattatagcagtgctgatggagatgacgaagaagatgatgatatggatgattttgatgaagatgacgatgatagcgatgacgatgatatgataacagatatcggtgatatggagttttctactgaggtacctgcaggtggagcagacagcagctttgatgtctcttccattcgaaatatcaagctggatattgatgcagcggaaattacagtcaaagaaccggatgacagtacgaagatccgcgccgtattaaaacacggtaaggagaaatattattcctgcaggttggatggtgatacattaaaaattaaatacgatgcaaaaaaacactattataaaagatcgccgcagatcatcctgtatctgcccaagggaagttcttttgatgagctgaattttgacatcggtgctgcagacatgagctggaaagattttgatgtcagctgcaacaatctgattctaaaagtcggggccggtaattttgaagcagagcagtttcaggtatacggaaagatggatgtatccgtaggcgttggaaatgtggagattacagacggtgtagtttatggtgatgttgcgttagactgtggggttggcaatttttccatggagggaagtgttgagggtaacctgaaagcagactgcggcatgggaagcatgacactcgatttaaacggcgaggaaaaagagtataactacaaactttcctgcggacttggttcgattgatgtggatggtgaaacttactcaaacatcagcggagataaagaagtcaaaaatgaaggggcagagaaaaatatggaacttgactgtggcatgggaagtattgaagtggattttgagtagactaagatcctgtgtcagttgacaattaaggtgcaaatcattatgataaaaatgacgtcggcgtacaatcgttgtacatcggcgtcatttttgtagtgtttctcagaccaaagaaaaacaaaacaatgcaaaaatgggggatctatgaataaaacaatcagaatcgtactttatgtactttccatactgactgtggcgggcgtgatcgcagcggcaattttaaccggcggccaggcaaaaccggcgtctgcgccgggggcgacggcagaagaggagcaggcggatatgtctgatgcgcaaaccactctggatggagcagccacagcggatggaagtggaatatcgacggatggtgcagaaacggcaggtgaagacggaagcatgtcagagaatgcagtcacagcaggtgaaaatggaagcatatcagatgatgcagccacagcagctggaactgggagtgcatcagatgaaacagcaaacaaggataatcaaaaagactccggcgatacaaccatcatcctgacaggtgatgttctttttgcaaatgctttcaaggcagcctatgatgccggcgggatcgagcgtgtcgtctcaccggaactgttagaacagttaaaggcagccgatatcctgatggtaaacaacgagtttccatttagtgaccgtggggaaccgatggcagacaagcagttcacattccggtgcagtccttcctatgtaagggcgttaaatgaaatgggtgtggatattgtatcacttgcaaacaatcacaccttagattatggaagagcggcactatcagacactttcagtgcattagacggagcaggaatcctgtacggtggtgccggagattcggtggagcgtgcaaaagaagtgcagattatggaagtaaatggaaaaaaatatggatttatcgctgtatcgcgcgtggtaccgtctgctgattggaagatcgagagtgctgcgccgggaatgtttacctgttatgatgccacagcactgatcgaagtgatcaaagaagcaaaacagacctgtgattttgtgacggtatttccacactgggggacagagtacagcgaacagccgaatgccgtgcagcgtgaactggcaaaacagtgcatggatgcaggtgcagatctggttgtcggagcgcacacacattgtctggaaggaatcgaatgtattgacggaaaacccgtgttttacagtctgggtaattttattttcggacagaatattgacagatccgccgctgtgaaagttacagtgacagaagatggaacagtttcttatgcgctgattccggtctatgcatcggacgggcagacaaaacagatggatgcgaatgcggcaccggggctgttttcttatatggagagtatctcggacaatgcttcggtagatgcagcgggaaatatcagtgaaaagtagtataggaggaatagtatgaaaaacaaaattttgggattgccaaaggcagctgtgattgtcattggcattgtgatcacggcactgtttctggtgttgatgaatctggttggagcagcggcgacacatttcacaaccatcatggacagttatacgttacagtttattgctgagatcggcgtggcagtttatgcgatcggtatgctgtttcttacaggataccagcagtcacttagaaaaaccggcgtgggctttctccggggattttatactggaggatttatggtaggatactgcgtgtatgtggcagttgcacagttatttttgcagagtgtttccggttcggacggagtgcgctctgccggtgggatcatgatttacatactgaccatgtttttggtcggcatgaacgaggaagtgatcatgcgtggaatcgtgttaaacctttttgcggaccgtttttcaaacacaagacggggagtgcttgcagccattattttatccagcgtgatctttggtgcggcacatatcccgaatgtactttccggtgtgccattatccagcgcattgatccaggcactgcaggcaacattgctcggtgtgctgtttgcagcaatctatctgcgcagcggaaatttatggatttgtatcattattcatgcacttgttgattttggcggattaatggcgagtggcatctttggaaatggtgatatgacggacatgatcggcagcctttctgtgttaaatcttgtagtgacagttccgctgtttttggttccatgtatcgtattactgcggagaagcaagttagacgagattgtggaaatgagagaaggtgagattatcatcccgtcagagcgtgagggagaaaatattgcgacggtatcattagttcttggaatccttggcattgtgacagggtttgtgggatatggagcaggatttggtctggtcggtctgcttggtgcaatctgttcgaaaaagataaaaccacagcagaacggtacagcaaccgctgcattgatcacttcaattatcggactggtgatcgctgcactaatgattactgcaatcatgtttctcatgccggttttaagtgataccagtacacttgaatccattatgaatcagtgattctgtctgggtgaggaatgctgcctgcggtattgatgcggggaaacaccatatttttctttaaatgaccggatcaggtgactgcagtcggcgtatcccgtctcctgactgatataatttagatcaaagtttgtaaaaagaagcatatcttctactttgcacagccggataaattcaatgtattttttacaggactgcccatagatttcacggaaatttttagcgaaatgtgaataactcatatgacagagtgcggcaatatcttctacacggatgttttcgcaggcgtgacggtcaatgtattctgtgatggtatagatcgtattttccttcgcaagcggggtaaaataacagtcggtatcaaaaccattgttgcgccagatgcgaagcagccaggtcagaagttctttgacctttgactgcaggatcatctgatacccatactgcatattttgcatttcgcggacacagtcgtcaaataaagactgtaccggaagagagtggagtatctcctcctggaaataaatatcagcctgctcgttatttatggcattgttaaacagtgcactgtaattccagcttccaccggtaagagaagcggaagaatccagctggcttaggtcaaattttaaaacataatactgcagaggggcatcggacactgcatggacagaatgaacgacggaggggagaaagacgatcatgtcaccttccgtcacaatataactttgttcattctgatacatcagggcggtgccccttgttacatacaggatttccataaaataatgccagtgtggctgcacgggcagccattctttcttcatatctaaaaagaaacattcgtaaggtttgttcagtttgtcggtatattcaaataaagatttcataggcggctccataaaaatagatttatacaatttttgatttgaaaaattatagcagatatatatgacgaatgctatattaatggcagaatctgtaaaataaaaattaaaaaattatatttttgaaatcataatgagaaaaagggaggacaaaaacgatggaatatatctgtggggtgacttttgcaccgtttgcgtgtgccggggctttttttaaaccgggggcaaaggagagccttgccatgatgaaagagagaaccggcgcaaatttcgtgatatttgtgcctggagggttacaggagacaccgcagtcggaggagatctgcttcacatcaaaggcgacgatggaagatgacgagctgatcgctatgattgaatatgcaaaggaaatagggcttcgtgtggcattaaaaccgaccgtaaactgtaaaaacgggacctggcgggcgcatattaatttttttgatgaggatgttccgtgtgaaccgaaatggggaaactggtttgcatcctatacggcatttcagcttcactatgcgaaaattgcagaacagcatgactgtgaaatgtttattgccggctgcgagatggtgatgagtgagcaccgtgaagcagaatggcgcaaactgctctcggatatcagacaggtctatcatggactgctttcctataatacagataagtatcaggaacaccgggtaaactggtgggatgctgtggatgtgatttcttcgagtggttactatccatatggggactgggaaaatcagctggatcgtattgaaaccgtggtaaacagatttcaaaaaccgtttttctttgcggaaacaggatgtatgtcggtaaaaggttccaaagaggtgccaaatgactggtgtgtaagaggtgatgcggatccaaagggtcaggcagaatggtacgaagatatgtttacggcgtgcagtaaaagagactgggtaggaggtatggcgctctggtcctgggatgcaaagctttatcaggagcggagcgcaaagacccgtatggactatgaaatttatgcaaagcccgcagaaaaagtcgtaaaaaaatattatgatatttttaataaatgatgttgatgtcaaaagctgatttttaaataaaaatagtcaaaaggttaaaattagtttacaataacttaaaaaaaggttataatccaaaatataataaaaaatgaatcgcagaaaagtaaaggagaagaagaatgagcaattacatggaaacatacaaacagtggtgcacagatccatattttgatgcagatacaaaggctgagttaaagaagatcgagggggatcaggcggagatcgaggatcgtttttacagacagttagaatttggtaccggtggtttaagaggcgtgatcggagccggaaccaaccgtatgaatatttataccgtacgtcaggcaacacagggacttgcaaattacattatttcccagaatggacaggaaaagggtgttgcaatcgcacatgactccagaattatgtccccggaatttaccgaggaggcagcactctgcttaaatgcaaacggcattaaggcatatgtatttgacagccttcgtccgacaccggagttatcttttgcagtccgcgagttaggatgtatttccggtattgtaattacagcaagccataacccgagagaatacaacggatacaaagtatactgggaagatggtgcacagatcacaccgcctcacgacaaaaatattttagcggaagttgcaaaagtaacttccttcgatcaggtaaagaccatggcaaaagaagaggcagttgcagcaggcctttacaatgtgatcggtaaagagatcgatgaccgttatatggaagaactgaaaaaacagtccattcatccggagatcatcaaagagatggcaaaagatatcaagatcgtatacacaccgcttcacggaactggaaatcttccggtgcgccgcgtgttaaaagagcttggttttgagcatgtatatgtagtgccggagcaggaaaaaccggatggtaatttcccgaccgttgcatacccgaacccggagtcaccaaaagcatttgaacttgcattaaaacttgcaaaagaagtggatgcggacatcgttcttgcaactgacccggatgcagaccgtcttggcgtatactgcaaagatacgaagagtggcgagtatgtgacatttaccggaaatatgtcaggtatgctgatcgcggaatacattttaagagaaaaaacagcaatgggaactatgccgaagaatcctgcactggttgagacaatcgttacaaccgatatggcaaaagcgatcgcaaaagcttacggtgtaaaactgatcgaagttttaactggatttaaatatatcggagagcagatcaaatttttcgagcagcagaatacttacgattatgtgtttggtttagaggaaagctacggatgccttgcaggtacttacgcaagggataaggatgcctgtgttgcagtcatgatgttatgtgaggttgcttcctggtgcaagaagaacaatatgaccttatgggatgagatgcttgccatgtatgagaaatacggctattacagagagggacttgagacaaagaccttaaagggaatcgacggagctgcacagatccaggagttgatgagcaattccagaaaaaatcctccgaaaacacttggcggatttgatgtgcttgcagtgcgcgactataaagaagataccagaaaagatactgtgaccggagaagtgacaaagacaggtctgccggaatctaacgtactttactatgaactttctgacaatgcatggtgctgtatgcgtccgtccggaacagagccgaagatcaaatattactttggtgtaaaaggcagttcattagaggatgcagaaaagaaacttgccgtgttaaaagaagacttgctgaaataacaggaggaaatacagcatggcaatcacatactttgaaaaagaacgcattttcaagctggatacaccagcctccagttatgtgatcggtatcgtggataaagaaaactttgtcggtcatgtttattatggtaagaaattaagagatgcaaacattgcatatctgctccgcacgggagagggaccgtttgtgccttctgaaaataacagagagagagtatcattctatgatacgtttccgatggaatatgcaggaaacggactcggagattacagaagaagcagtatttctgtgagaacagagggaggccatacggcagtatcactgttttatgtgtcacataaaatttatgcaggaaaaccgggacttgccggacttcctgcaacgttcggcgatgaagattcctgtgagacattagaacttctatgcgaggatccggtacttgggttaaaggtaactttgctttacacggcattttctgatgtggatgtcatcacaagaagcgtgcggatcgaaaatgacggcgagatgttatatctgacaaaggcactgtccttctccatggatatggataaccgtgattttacactgcttacgatgcacggttcctgggcgagagagcgtatgttagaacaccgcaaagtaaaaaaaggatttatgggtgtggaatccgtaagaggtgagtcctcccatcaggagcatccgtttatggcacttgcggcaggaaatgccgaccagtcacagggcgaagtgtatggcatgcattttgtatactccggcaactttattggacaggtcgagttgggacagtttgataccgtccgtgtcggcatgggaatccatccggagaacttctgctggaagttagaaaaaggtgagagtttccagacaccggaagttgtgctggtttacagtgacaccggatatgacggcatgacgcaccagttccatgaactttaccggaaccacctgatccgcagcgaatataaggataagaaacgtccgattctgatcaacaactgggaagcaacttattttgatttcaatacagaaaaattactttccattgcaaaaaaagcatcggaacttggcattgaaatgctggttatggatgatggctggtttggacaccgcaatgatgattcatcaagtctgggtgactggtatgtcaacgaagaaaaattaaacggtggtttaaaacatctggtagatgaggtaaataagcttggattaaaattcggtatctggtttgagccggaaatgatctcaccggattcaaaactttacgaggcacatccggactgggcaattcagattccgggaagagagggatctctctgcagaaatcagtatgtacttgatcttaccagaaaagaagtgcgcgattatgcatatgagagcgtggcgtcgatcttacgcagtgcaaatattgagtatgtcaaatgggatatgaaccgtcagctttctgacatcggaagctatggacttcctgcagaccgacagggtgaactttatcaccgttatgtgctggcagtgtatgagatgcaggagcgtctggtaacagagttcccacatcttttactggaaaactgttccggcggtggggcacgttttgatccgggtatgctttattacagtccacagatctggtgctcggatgatacggatgcggtggagcggttaaagattcaggaaagtacggcgatgatctatccgttatcgacgatgggagcgcacgtttcagactgtccgaatcatacggtgggacgtgttacaccgtttgagacaagaggtcatgtagcgcttgcaggaactttcggttatgagctggatatcacaaagattccggaagaagacagacagatgatcccgaaacaggttgccatgtatcataaatacaatgatctggtaagaagcggcgattattacaggatcgcctcctatcaggaaaatcattattttgactgttacgaggtggtttcaaaagataaatcagaagcactggttacatttgtgcaggtgatcaaccgtccgaattataagagcagaagaatcacattaaaaggactcgatccgcagaagaattactgtctggaaggcgaagatactgtatatgcgggagatacattaatgtatgcaggtattctgatccagaatccatggggtgatttccagtcaaaactgttacattttgtggaaaagaaataagattaaatcgaaaaagtaaaaagtagtaagaaggggacggttatggcaaaagcagtaaagctggcagacattgcagagcagcttggtgtcagtacggtcacggtctcaaaagcactttccggacaaaaaggtgtcagcgaggctatgcgggaaaaaatcaaacaattggcagatgaacttggatacaagcagccatctgccgtaaaaaaagaaaagtcagtaaaaagttataatatcggggtgctggtatcggaaaaatacttaggagagtatgcatccttttactggagaatgtaccagagtgttgcaacaagggccgttcagaaagaatgtttcacgatgcttgaggttgtttcattagaagatgaagccgaggcgaatctgcctaaaatcgtgctggaacgtaaagtagatggtctgattctgatcggacggctgaggacagaatatttaggtgcattaagacagaatacacagattccgatcgtgtatcttgatttttatgatgaacaccagatgagtgatgcggtgatctctaacagttactatggtacttacatgctgacgaattatctgatcgagcatggtcatgaaaaaattgcgtatgtcggaactctgttgtttacagcaagtatcacagaccgttatttcggttaccggaaatccatgttagaacatggtattgaagtgccacaggagtggatcatatcggatcgtgatatggaatgtggtgtggtagaggttgatattcatccggatcagatgaaagatatgccgacggcatttgtgtgcaactccgatctcacggcaagcatggtcatcaatcagttagaagagcaggggtatcgcgttccggaagatttttcagtggttggatttgataactatctttttccgggactgtgtgatgtcgagatcacaacttatgaggtggatatccgtgaaatggcaaataaagcaatacatgtgctgttaaagaaagtcagcggggaacgttataaacagggaattaccattgttgagggaaggctggtggaaaaagccagcgtgcagcaggttgtaaaataagagaaagcggtaagttgtgaaaggcttgccgctttctctttttttcgtttcatggatttcacaccaaattttggcttgtggttgacatgcttcgcccgtccaaatggtgtgtcgtaggtctgtgaatggcattttgcgcaaagccggagttaattttggttccgttgtacgaaaataagaaaagtctaggtatgcctggtttagattttctcggagtgacgtgaccggcaacaacgagtcatccatgactcgatgctgccttgttctgccatccgtggcagaacatcactatgtgtagacaggcacaccaagattttctaattttcttccaaagtcacaaaattagctctggctttgcgcaagatgccagccttcaggttatgaacaccatttgggcgggcggttcatctcagaattgggggtgcgggtgtgaatttttgatattcgcacgaatggaaatatgcttaaaatcgtaatgtgctgtatcattaatattcagcctgatgacttgtctgaagtttcatctgctatgttgcattacattaatcatttcgtaaattaccagactgataatgcagattattattccaagtatgtatgtttaaaagcatagatataacagattgtgtcgagatttttcaacctttttgaaatgaatgtcacaaaaatttacgcacccccaaggttgtaaaatgagttccccgacgaagagtggttcacaaccttgcggctggcaaatcgcatcaagccgagactcgttttgtgactttggaaggaaattagaaactcttaggatgcctgttcgcaacatagtgttgtgctgccatggacggcagcacaagtcctaatgtgcccggatggcgcatttaggacgtacacgtcactccgccccaacctgaatcaggcatgcttagagtttcttattttcggacaacggaaacaaaacagtcccggcttgatgcaatttgccaatcgtaaccccccagaaccaccctacacaaggaaactcatgtcacccacaaaccatcatttggtgagcatttcatattgttaagttatggatgttctgcagataacgctgtggtgaaataagtaattagttaaactaaaatcaaggtaaataagtaaattaatcaatttacaaaatatagactaaaataagctaaaaaatgaaactaaaacaaaaataaatgtgaaaaagtgcacaaaaacagcaaaatagaattgtctatagtgccgaaatgcacaatagaagggttaaaatggactaaaatcaggaaaaaagtgttgactaaaaaataaaacgatatataattaaattaagttacaaaacaagtaacaaacatcataaggaggaaaattctatgaaattaagaaaagttttagccgttactttagtagcagcaatgaccatgagcatggcagcatgcggtggctcaaacaacacagcaggcaatgggggaacaacagacaacaacagtgcagcagcagataacagcacagatgcatcaaatgatgtagcagcaactgagagtggtgatgcttctacatccacagacggatctttatcctatgcagacatcaaactcggtgaggattatacagatctgacagcaacaatttcgttattcaaccacagaacagatcttgaatctgacgattataacggaacaacatggaaagagtatttagcggcattcaatgaaatgtatccaaatattacagttgaacttacaaccgataccaactatgcagatgatgctctgatgcatttacagtctggtgactatgagacagtcatgatgatcccggcggttgataaggcagacttaagcaattactttatttcatatggtgatcttgataccatgaagacccagatcaattatgcaactacatgggagtatggcggacaggtttacggtgttccttctacagcaactacacagggtatcgtatacaataaaaaagtatttgaagaagcaggagttacagaacttccaaagactccggaagaatttatcggtgcattacagaaaatcaaagataatacagatgccatcccgctttatacaaactatgcagcaggctggacaatgggagcatgggatgcttacatcggaaataatgcaacaggcgacaatacatatatgaaccagaaattagttcatacaaaagatccattccagaattatggcgatgatacacatgcttatgcagtttacaagatcctctatgatgcagttgcagacggactgatcgaagatgactttgcaacaactgactgggagggctgtaaaggtatgatcaacaatggtgagatcggttgtatggtacttggctcatgggcttatcctcagatggaagcagcaggcgaaaatggcgcagatatcggttatatgccattcccgatcactgtaaatggtgagcagtatgcatcagcaggtgctgattactcttatggtatcaatgcaaatgcaacagatgatgaaaaagcagcagctatggtatttgtaaaatggatgacagaaaaatccggtttctcatacaacgaggatggacttccagtcgcagccggcagtacagatacaaaactttccttcgatggcgtaacattcttagaggatgaacctgcattagctggcgaggaagatttcttaaatgagatgaatgcagagtctgagttaaacattaacgcaggtggagacagtaaaatccaggcaatcattgagcatgcatccaatggcgataagacatttgatgagatcatggacgaatggaacacagcatggtctgatgcacaggaatcaaacggaattgaagtaactgagtaatatagttccacaaaagggaaggggaggttccccttcccggataaaagacaatggatggaggaattgtggatatggaagggaaaaaaccattcagttttacaaaatgggcaaaaagcagaaaaggacagcaggtgatcatctgtgtggcatttatgacaattccgctgttattgctgtttgtatttacttatctgccttttgccgagatggtaaaattcagtttttataagatgaaatatttaactccggtagatcagagaaaatttgtcggatttaaaaattatattgacgtatttcgcagggatgactgctttggagcattaaagctcagtctttattatatggtaggtgcgattattcagcttgtacttgcactttatctggctactattttaagttttaaggtaaagggaggaaacttcttcaaaggattaatgttcttcccatatctgatcagtggtattgcaatcggatttatttttaaatttttctacaccagaggatttgtatttgatacgatcttacaatggtgtggatttaaacttgacaatcttccatactggctgaaagatcagtcaattaacaactggtctttggtggctacttcggtatggcgttattttggacagaacatggtattgtttatcggtgcaatcatgtctgtggatgcagacctttacgaagcagcagagttagatggtgcaaataaatttcagcagtttaaacatattattctgccgagtatcaaaacaattatcactttaaatgtaattctttctatcacaggttccttaagtgcatttgagcagccttacgttatcacagatggtgcaaatggaaccggaacatattttgtaattatgaatgagatcgctcatgtaagccagaaagtcggtcttgcatcagcaatggcagtcgtacttctccttatcatttttgcatgtacgattttacagaagttattctttaaatatatcttccgtgatgctgagagtgaggatgaatcctacaaggcaaaacgcgcaagattaaaagcagaaaaacaggcaaagaaagctggaaagggagtggcataggaagatgagaaaacataatgtaaatgtgcagaaaagaaaaaaacattataccgttggtgcaatcctctggctgatcgttgaatatgtatcgttgattttctttggactttgtgcagttgttcctgttatctcctgtgtgattacagcgtttaagacacaggaagaatatcagacgaccaatgttatgacattgccgaagaactggctgaattttgataattttattaaagcatttcagacagcggatatgggaagagctttcttaaactccgtgatcgttatggtatctgtcctggttgtttccattgtaatcggaacacagcttgcttatgtattaaaccgttttaaattcccgggaaacggactgatccgaaacctgtttttgtttgcttcactgcttccggcagttgcaatgcaggtaactgtatataatatcatgacagcactgcactttgtcaatcatttatatggatatattattctgatgtgcggaacggatgttatctcaatttacattttcattcagtttatggaaaatataccaatatctctggatgaatcggcaatcattgatggcgcatcctattggacaatttactggaaaattatgcttccactattaaaaccggcaatcgtgacatcctgtattttaaagggcgttggtgtttataacgagtactatatggcaaacctttatctgatggataaaaagttacatacaatcgcgacatcactttatacatttgttggcccgatgggaagtcagtacaatctgatctgtgcaggtgttatcatttccctgcttccggcattgatcgtatttatcctctgtcagaaacagatttacagtggaattgctgctggtgcagtaaaaggctaaagagagaaagaggaaacggttatgagtgagttaaaagaacttgcagcagaagcaaaacacgaactgctcacacatatcattccattttggagaggtatgcgggatgataagttcggcggatattacggttatctttcctatgatcttgcactggatgaaaaagcagaaaaaggatgtatcttaaacagccgtattacctggttttttgcaaatgcgtatttactttataaagacggcggcatttcggaagaggaatgcgaggcagcaggttttaagggagaagacctgcttgccgaggcaaaacatggttatgaatttttaagggaacattgtatcgacaaagaatacggagggatcttctggtcattaaattatgacggaacaccacttgatacaactaaacatacatacaatcaggcattctgtatttatgcgttgtcatcttactatgatgcagccggggataaggaagcgttagaacttgctttttccctgtttgatatcattgaggagcgctgcacggatgagatcggatacttagaagcttttacaagagattttaaaccggaatcaaacgaaaagctttctgagaacggtgtacttgcagataagacaatgaatacactgcttcatgtttttgaagcgtatacagaattgtaccgcgtgacaaaaaatgaaaaggttggaaagagactgatgtggatcatggatacctttgcagataaggtatacaatccggcaaaacagcgtcaggaagtattttttgatgcagactataacacaatcttagaccttcattcttatggtcatgacattgagacagcatggctgatggatcgcggtgtcgatgtattaaacaatgaacattaccgtgagaaaatgacaccgatcacaaagacactgacctcaagaatttatcaggtggcatttgatggtcattctcttgcaaatgaatgtgaccgcggagtggtcaatgcacaccgcgtctggtgggtgcaggcagaaaccgttgttggtttcttaaatggttatgaaagaaacacaggacattctgaatattgcgatgctgcactggcagagtgggagttcatcaaaacctatgtggttgataagagaaatggttctgagtggttctgggaagtcaatgaggatggaagtccgattttagacagaccgatcgtagagccgtggaaatgtccgtatcataatggaagaatgtgtatagaagtcatccgcagaatcggagcataaaacagattcatttatttttagaaaaagaatggagattcgacgaatgttacatgagagatattatgtagaaaaagaaaagcaggaaaaactgctttcccgcaaaaatgtaaaatcggatttttacaatggtgtttatgaccgttatgaatatccggtattgacaagagagcatattcctctgacctggagatatgacttaaacccggagacaaatccatatttcatggagcgtcttggaatcaacgcagtgatgaattccggcgcgatcgaactgaacggaaaatattatctggttgcgagaatcgaaggaaacgatagaaaatctttctttggtgttgctgagagtgacaatggaattgatggtttccgtttctgggattatccgatcctgttaccggatacctgtccggaagagaccaatgtctatgatatgcgtctgaccaaacatgaagatggttacatctatggtgtattttgttctgagtcaaaagatacaaccgtaaacgatctttccgcagccgtagctgcagcaggaatcgttcgtactaaagatttaaagaactgggagagactgccaaatcttgttactttaaattctccgcagcagagaaacgtggtacttcatccggaatttgtagatggaaaatatgcattctatacaagaccgatggatgactttattgaaaccggatcaggcggaggaatcggatttggactttgcgaagatatcacacacgcagtgatcgacgaggagaaaatgacaagtcttcgcaaatatcacacgatcacagaggcaaagaacggtgcaggtgcaactccgatcaagacagacaaaggctggatccacattgcacatggtgtccgcaacaccgcagcaggactccgttatgttatctatgcatttgcaacagatttaaacgatccgtcaaaagtgatcgcagagccgtccggactcttaattggaccgagaggtgaagagcgtgtcggtgacgtaagcaatgttgtatttaccaacggtgcgatcgtaaatgagaataacgaagtatttatctactatgcatcttcggatacgagaatgcatgtagcgacaactaccgtggataaactggtagattatgtatttaacaccccacaggatccgggcagaagcgttgagtgtgtggcacagagatgcggactgatcgagaagaatttagagtttcttgcaaaagaaaacaaataagaaataaatgcagaaaatcagatgactgcatacaaagttttgcataagtgcagaaaaatgaagatcgaaaagtaaattatagatgcgtggacgaaagaaacgcagaaatggaggaagaagatgagcaaatataaaatgatcagccagccggtaccaaatgtaccatggcaggaaagaccggaaaacttaacaggagcaccggtatggagatacaatgagaacccgatcatcggacgtaacccggtaaaaggtgttgcaagaattttcaacagtgccgttatgccgtatgaagatggattcatcggtgtattccgtggagagcagactaacggtattccttacatttaccttggaagaagcaaagatgcgatccactggaattttgatgaaaacaagatcaatttcgtagacgaggaaggcaaaccgtttatgccgcgttatgcatatgatccgcgtcttgtaaaagtagaagatacctattacatcatctggtgtcaggatttctacggcgcagcaatcggtatagcaaagacaacagatttcaagacattcacaagaattgagaatccgttccttccattcaacagaaatgcagtgctgttcccaagaaagatcaacggaaacttcatgttattatcccgtccgtccgacagcggacatacaccgttcggtgatattttcgtgagcgagagcccggatcttacttactggggaaaacacagacatgtgatgggcaaaggctctgagtggtgggagtccttaaagatcggtggaggtgctgccccgatcgaaacatccgaaggatggctgttattctaccacggagtaagcggaacctgtaacggttatgtatattccatcggtggagcaatcttagacattgacaatccatctatcgtaaaatatcgttgtgagacattcttactcacaccggaagaatggtatgaggagcgcggatttgttccgaacgtatgcttcccatgtgcaacaatccatgattccgaatccggaaaaattgcaatttactacggtgctgcagacagctatgttggtcttgcatttacagaacttgatgatatcattgattacatcaaagaaaacagtgtcgtaacaccggaagataccgagatcggaagacgctaaaattgctgctattcatccttaatagcataaaattgattcgtaacacaggctgccagatgcaatgaaaattgcggcagccttgttgcgtaattcatgaaacgtgtgatggagtgtccgcagaacgtgcattttatcataatggaatgtccgcggagcgggcagtctgcttacatatttaatttttggaggggaactcagaacatgataattaaaccagataatgagatgttatcttacagcggaagaattgattttgatgacaggcttgcaccggttcttgtctatgcgtgcagctcaattggaatgaaatttaccggaacatccttaaaggcagtgatcgcaaaccatcgttcctgctggacgaatgaactgggatattttatagacggggaacagaagcgttttaccttgtcgtctgatgaagagaaaaagacttatactttggcggagggactttcagagggaacacatgaactgctgttatttaagcgtatggattcctgtcatacttttacgttctatggatttgagattgatgatggagcggaagttctgccactgccggaaaaaccaaaacggaaaatggaattttttggtgacagtgtttcctgtggagaagtttcggaggctgtggcatatgttggaaagccggatcctgagcatgatggggaatattcgaacagctggtattcctatgcgtggatgacggcgcgaaaattaaatgcgcagatccacgacacttcacagggtggaatctcacttttagatgataccggctggtttgcagcaccgcactataaaggtgtcgagtcctgctatgacaagatcgagtaccacccggatcttggaccgaccaaaccatgggatttttcacgatatataccacatgtagtcgttgttgcaatcggacaaaacgacaatcacccggtagactatatggcagaagattatgacagtgaaaaatccaaaaactggagaaaacattatcaggcattcatcgaaaaactgatgcagctttatccgaaggcgcagatcattttagctacaaccattctttgtcatgataaaagctgggaccgttccatcgacgaagtctgcacccgcatcggcagtgagagagtccatcattttctctacacaaaaaatggctccggcacgccgggacacatccgtatcccggaagcagagcagatgtcggatgagcttgcggcgtatatcaactcattaggggatgcagtctgggaatcttagtttcgcaccggaaacagcaaaaaaggagagaatatcaaatggaatatcaaatcaaatacgaaaacggcattgccaaccgcggctgcttataccgcctgaaaaaagtcatggaccgcgccaaagcaggcgaagctttaaatattgcatttttaggcggctcgatcactcagggaagcctttcttccaaaccggaactctgttacgcataccatgtctatgagtggtggaaaaagacatttccacaggctgattttacttacatcaatgcaggaatcggcggaacaacctcacagtttggtgtggcgcgcgcagaagctgatctgctttccaaagagccggattttgtcatcatcgagttttccgtcaacgatgacagcacggagcactttatggagacctatgagggactggtgcgaaaagtatataccagtaagacaaaaccggcagttcttttagtgcacaacgtattttacaataacggtgccaatgcgcagctgatgcacggacgcattgcaagatattataatcttccggctgtcagcatgcagagtacgatctacccggaagttgtcgccgggcgcatcgaaaaccgtgagatcacaccggatgacctgcatccgaatgatgccggacatgcacttgtcgcatcggtgattacatactttttagataaagtaaaaacagaagatgcaacggaacagagcgaaccggattatccgacacctctcacaaaaaatacttatgagaaatccatccgtcatcagaacagcgacgaaaacgtagtctgccatggatttgtcgcagatacgtccgcacagagagatattaccgactgtttcaaacacggatggacagcttcaaagaaaggtgattccatcacacttgatgttgagggctgcaatatttcagtacagtacagaaaatccgtaaaacttccggcaccggttgcagagatcattgtggacggcgatgcagaacatgcagtccgtctggatgcgaactttgatgagacctggggtgataaattagaacttgacaccatcttagaacatggcgaaaataaagtacataaagtggaggtgcgtctgacagagacacacgagaatgatgcagtgccattttatctggtgtctgtcattggttcctctgaaaaataattcactgggaaaggaaaagaagaatgtttcgggatgattttgtttggggtgttgcgagcagttcctatcaggtagagggaaccgatgcaaacgatggaagaggaaaaacagtctgggatgcatttacggaggcaggcaggattttcgaaaatcagaatgcttatacgacctgtgatcatatgcatcattataaggaagattacgcgctgatgaaaaatcttggtatcaaggcatatcgtttttcattaaactgggcacgtattctgccggaaggaaccggtcgtgtcaatgaaaaagcgatccggatgtaccgtgatatgatcacatgtatgaaagaaaatgggattacgccatatattaccatgtttcactgggagtttccgcaggctctttatgaaaagggtggctggctgaacccggaagtggcagactggtttggtgagtatgcgaaggtagttgcagagcgtttttccgatatttgtgaatactttatcacgatcaatgaaccgcagtgtgtggttggacttggacatttaagcggtgtacatgcaccgggagtaaaaatgtcaatcaaagatactttccagatcgcacacaatctgatgaaggcacatggccaggctgttatcaatctgcgtaaatatgcagtccgggatatcaaagtcggatacgcaccgaccggaggtgtcgcttatccttatacggataaaccggaggacattgaagctgcgaaaaaagtatattttggtttctataatccgatggataactggacctggaatgtagcatggttttcggatcctgtatttttagggcattatccgaaagaaggattggagaaatttgcgcagtatctgccagagatcacggaagaagatatgaagctgatccatcagccacttgattttatgggacagaatatatacaatggttactatgtccgtgcaggagagaacggtgaaccggaatttgtggaccgtgaaccgggatttcctaagacaggagcagactggccggtaacgccggaagctttttattatggtataaaatttctgacagagcgttatccattgccgctttacatcacggaaaacggcatgtcctgtcatgataatatcagcgcagatggcagggtgcatgatccaaaccgtatcacgtttctggattcctatatcggagccatgcagcgtgcaagcgatgaaggtgcagatgtaaggggatatttcctgtggacatttcttgataattttgagtggtccgatggatacaaacagcgttttggtatcatttatgtagactttacaacgcagcagcgcattgtaaaggattcggcattctggtatcagaaagtaatagaaacgaatggaggaatacttagtatgaatcaggcaaataaagatattttatttttagacccggtatgtacgcacaatatctggggcggtacaaagttaagagaggagttcggctatccggtagagggtgatgacatcggcgagtgctggggcatctccgcacatccaaacggagacggaaccgttcgaagcggcgcattttccggcatgaagttatctgctgtatggaaagaacatccggaagtgttcggcaattacgactgtgaccgtttccctcttctcacgaagatcattgatgcaagagacgatttaagtatccaggtacatccaaatgatgattatgcaaaagtgcatgaaaatggttcttttggaaagacggagtgctggtatatcatggatgcaccggagggagcaacacttgttatcggacataatgcaaagacgaaagaagaactttccgatatgatccatcagggaagatggaaagaatttatccgtgagattccggtgaaaaaaggtgattttatccagatcgatccgggaacggttcatgcaatcaagggtggacttttaattttagagacacagcagaacagtgatattacttaccgtgtttatgactatgaccgtctttcaaatggcaagccgagagaattgcatgtagaaaagagtattgatgtgatcacagttccggcaaaatctgtggatgacagtgtaaaatccgcattgaatctgccggaaaatcagttgaatgagctgtattcctgcaaatactatacgatctttaaggcagatgtaaatggaaagatggaatttgagcagaagtatccgttcctgttagtatctgttttagagggagatggaatcgtgggcagcagcccggtgaagaagggagatcattttatcctgccgaatggttatggaaaagttgagatgcaggggaagatgagtctgatcgtttctactgtaaaataattattttgagatgaaaaatccgcaggatgtgagagcgcacctgcggatttttttgatgaacggggcagacttggtgaatagcaatgttaaaaacggggcaaaatataattatattaaatttaaaaacggggcaaattgtaatgataatgattgaaaaaacggggcagatagtgtattgtgtaattggaggtatgaatttatgtacagaaaagattcaattgcaattggtgaatggattaaaaattcaaataaggcattattagtgacaggagcaagacagataggaaaaacatggctcataagagatgaaattgaaaagagcggatatactaagtttgaagtgaattttattgatcagccggatatggtttcctacttaaatgcagagatgagtgcggaagattttttgattaaattaaaaatgatcatgccagaagattgcaaatcgcatgaaacggttgttttttttgatgagattcagaaatgcccggaaatagtaactaaaataaaatttcttgtagatgagggaagttttaagtatgtaatgagcggatccttattaggggtagaactgaaaggtatcgcttcggctccggttggatacctgactgttttaaagatgtaccctatggatttcgaagaatttatgatggcgaataatgtctcagtaactacattagatatgctaaatgaaaaatttaaaaacgccagtcctgtggacgaatttgtacatcagaagcttttgtctatgttttttgtttatcttattgttggaggaatgccagatgctgtaaaaacttatatagaaacaaaagatattcgagaggttgacaaagtacaacgtgatataacaacgctttataaagaggatttttcccaatatgagattgaggacagaaagcttaagttaaagtccatatatgacattattcctgctgaactaaataagcagaataaaaagtttgtatttacgatgttggataaagaactgaaatttgacagatacgaaaatagttttttgtggttaaaagatgcaggtgtggcgttgccggtttataatattgaggcaccagttattccacttttagcaagcaagagcagtaatatattcagacttttttcgagcgacattggattgttgacaagtgcatatccggcagaaacaaaaatggaattaattaataaaaacggagaagtgaacaacggagcacactttgaaaatgctgtcgcacagcaattaacggcgaatggttttacaccatatttctgtaaaaagaaaaatattggtgaaatggattttgtgatagaaatgaatgggaaagttgttccgattgaagttaagtctggtaaggcatataaatcacacaaagctttggataattttatgaacataccggattatcatcttgagaaagcctatgttttttccgttggaaatgtagaaacagaaggaactgtgacatatcttccaatctatatgtgttatctgttaaaagagcagaaactcggtcagatgatcgtagagttggatactactggtttgtagatcaaaaaggttattattatcatagatgagtatgacgttctgttaggctataaaaaggactgtaaagttgtgattggagagtagtggataggttacaattaactggacagattttttaaggtcatataatctataataaatacacgaaggagcactctttatgaccgaacaaaaacaacgacgaaaacctcgcaaatatacagatgaatttaaacagcaactggtggaactatatcgttccggcaaacgcagatgtgatatctgccgtgaatatgacattgctacttccctgtttgacaagtgggtaaagcaggcatccaattccggttctttccatgaaaaagataaccggactccggagcaggaagaactgatccggcttcggaaagaaaaccagcagttaagaatggaaaatgatattttaaaacaagcggcgctgatcttaggacgaaagtaaatgtgatcaaagcaaatgcccacaaatactctgtatcagcaatgtgccgcgtcctacaggtaaacagaagcacctattattatgaagcagcagcaaaaaaagatgaatcaaaactcactgcagacattcaggaaatttttagaaaaagccggaaccattatggtacacgaaagatcaagaaagaactggctgattgcgggaaacaggtatcaagacgcaggattggacggattatgaaacaggaaggtctggtatcaagctatactacagcacagtttaaaccgcaaaaagacagatgtaatgaatcaaaagtagagaatgtgttgaaccgacaatttcaaaaccagccataccgcaatgtagtggtaagtgatttgacctacgtaagggtaggaaaccgctggaattatatctgtgtactgattgatctttttaacagggagattattggatacagtgcaggagaacataaaacagcagaacttgtaaaacaggcatttatgaaagtagacggaaatctgtcggaaatccatattttccacacagaccgtggaaatgaatttaaaaacgagacaattgaagaactgttagaaacgttccatatggaacgctccctgagccataagggatgtccttatgacaatgcagtggcagaagctacgttcaagattataaaaacagaatttgtatggaatgaaacattccatacgcaggaagaactgaagataaaactatgggattatgtaaactggtataatcatcaccgcatacattcttccttagggtatcaaacgcctgtacaatatcggaaaaataacctaaaaaaatttgtctgaaaaagtgttgacaatccagtagatttaaagtctcaacgtagaaagctatgcctgcgttgagacttttttctagtgcagtgacctgttgctatttagaaaaatgatgtactggtgcagcacaattataagatgtctaatccagcctttaggagagcggcatccacaacgtgctcaaccagtacggaggttgtgacacttccgacaccgcccggaacaggagtgatcgcatccacaacaggttctgcgtcggcgaagtttacatcgccgcagagtttgccctcctcgtttacgttgatccctacgtcaatgacagtctgaccggcacgcagatattttgcgtcgatgacaccggctctcccggcagcaacgatcacaatatcagcttcttttacaacggatggcatatctgtagttttcgtgtgacagatcgtgacagttgcgtttttctggagaagcatcatggcggctggttttccaacgacagggcttctgccgatcacgacagcttttttgccggagcagtcgatgccatagtgatctaaaatcttcatgcaggcactcggtgtacacggtgcaaaaccggtttgttttccaaggaaaacagaggccatggatcggtcagtgatgccatcaatgtctttttctacggcgagcgcgttgatgatcttattttcatctaaatgacgcggcagaggacggaagagtaatacgccgtgaatatcgtctgcctcatttacctgtgcgatcgtatttaaaaccatttcctctgaggcatcttccggaagcaggaatttttcataggaaacgccaagagtttcacagcgtttagtcgcaccgcgctcgtaagaaatatcatcttctctttcaccaatgcggatgatgccgagttttggtgtgatatgatgtgcagtgagcagttctgttttttttcggatttcttcatttaaagaagcggtaacttcttttcctgataataatttagccattggtacctccatttttgcaagtttgtatctctgtttttatttttgcacatagattgtttgagaaaatgtacaatccatgtttatctgatttttgagcagacccgattgaaaatctcgtcagccttctgttcgtatttttcacgcagttcatcagcttccttattataggaagcggcagcttctttgtcagccatggattttgtgttgatgtagatatttaaggatgccccctgaagagcagattttagcagcgtggcgccgacaccggcatcgctgatggcaattttactgcccttttcagcaaaggtttcaatcagatcgatcgcctctgcgcaggtccgcatgatctcaagtggaacttcgcaggctcccactaaggcggcttccattacttctgcctttttttcaatttcttccggtgtgctttttggcatgccgtaggcggcacttaacggttcaaaagcttcggcgtctttttccacgagatctaaaagccgtgctgtgatgtcgtctgcttttttcttacattgaatgatatcctcttccacagcggcataggtcttttttccaacggtaagactcccgaccatatttccaagagcgataccgatcgcgccggcgagggcagcggcacctccgcctcccggaaccggagacttgccggataaaacggtgataaaatctttacaggaataatctgtaaagcatgaatttgtctggtgttccatgatattcctccattgcacattattctccatacctgtacggtatttttaagcattttcattcgataaattacattgattgctttattctaacatattgtaattttaaatgaaatagaaatcctgtaacccagtactttcgtacattaaaaaattaatgtatgaaatcaacggaaacagttgtctttttaccggtttttgttaaaatattagtagagttacctgggataaagcaatagcacctgtgttattgatgtacacatgaggaaaaggttatgaaaaataataaatggtatgtgatcagcacgtttgtacttggatgtatagtgataaattttgccggcaggattttgtctgacaggctgcagctgccgttgtggcttgattcttttggaacagtaacggcggcgtatgtgctgggacctttctgtggagctatggtcgggatgacggtaaatcttacctatgggattttatattcctggacaaatatgttttacgcagtggtcagtgccatggtcggcataacgaccggcatatgtgcgaaaaaaggatttttaaaaaatctttatggagtactttcaacaagttttttagtagcggttttatcggtgacactttctgtcccgtttaactatctgtattgtgatggttctacgcagaatatctggggagacggtgttattgagtctatggaaaaagttggatttaacagctttttcagtcactgtatgggacagttttatcttgattttcttgataaggttataacgatcgtcttagtatgttctcttataaaattgcttcagaaaaaaattgtatctaacagacagcatactttgctcatgatgtttctttgtatattgacgcttggtgtgatccggggagagacagtaacggcaaaaacagttacagaacaggaagattacagtagttatcttcagactgtttatggcagggaaaatggaataccgggtggatgtgccaatgatattgtgcagacgaaggatggcgttttatggatcggaacatatggcgggctgtaccggtataatggcacaaaatttcaatggatcaatgaatatgaatcgataaaaaccgtgaactgcctgtatacggatgaggaaggcagactgtgggttggaacgaatgacagcggactttccatctttatcaatgatacggttgcaaatgttattactgaaaaacagggacttgcatcggattcggtgcgctgtattacacagtgcgcagatggaaattattatgttggaacagccggggcactttccattgtcacattagcaggtgggttaaatgtgaaaaagacgatggaagatattgtgtatgtaaaaagtatggatgcagatgcaaatggaacagttgcagcggtaaccgatgatggaaaactgtattttatcaggcagggaaagatcatggatattgtggagccatccgagggagctgatttttcctgctgtaagtttgatgaaaacggacttttgtatgccggaacttcacagaatgagatactttgctatggctgtgatacgggagagtggaaatacagggaaacgaaaggctgtgaagaattatccaatataaagtcactgtattttttagatgacggagccatgtttgtctgtgccgataacggagtgggatattttgtagaacagacagattttaaaatgataaatacagatacattcaacagttcgattgatcatatgctgatggattatcagggaaatctctggtttacatcgtcaaggcttggcgttcttcgtttatgtaagtcggtatttacatcattgcagacaggagctatccaggaaaatcaagttgtcaattcagttacgaaatggcagaacaggttttatataggaacggacagcggattagaggtaatggatgaagagaccggagaagaatatacggatgatgttacggaaaccttagctggcacaagaatacgatgtattcggacagacagctgtggaaacttgtggatctgcacaacgggaaagggcatttatgagattacagcaaaaggagagacttttgtctatgataatgccagtggggcaaatggtaataaataccgtaccgtcgaagaactaaaaaacgggacgatacttgcggcaggagatgcgggacttacatttatccgggatggggagattacaaaagtgaccggtgaatcagatggacttacggtaccgaagattctttgtgtattagaacaggaagatggaaccatatttgccggcacggatggaaatggaatcgcggtgataaaaaatggaaaagtggaagatgtttacaacaaagaggatggattaagctcagaggtgatcctccgtatggtgaaaaatgaggatggaggtgtatttattgtaacaagtaatggaatctgttacatggatacggaaggaaaaatcaggagtcttgataaatttccttattataataattatgatattgtggagggaatcgaccatactttgtttatatcagggtcagcggggatctatgttgtggataaagaggatcttttgtccgggaggaaattagagtataaactgttaaacagtgatgccgggcttaaccgggcgctgacaccaaatgcatggaattatgtagatgagaatatgaatttctatttttccacagatacgggcgtgatttgtatggatcttaaaaattatgaggtttccgtccgttcctaccgtatgcagatgaaatccgtaaaaatagatgatgtatcgcattttgtcagacgtggagaggtgatctatctggaaaggggagcagaaaagcttgagatatttccggaaattatcaattattccgtgaatatcccttatgtaagtgtttacttagagggatatgacagtgagccgcaggtggtgtcccaaagtgagatgtccagtgtgatttatacaaatcttccggtaggaacctataagtttcatattgcggtgctggatcataagggacagaatccggtagtggaaagtgtgtataccattgaaaaaaaggcagagatctacgatcactggtggtttgtggtttatatagtggcagtgtttacgttagcagtagcttatctgacctggatgatttttcatacacaggtgcagagagtgatcaatcttcagaaaaaggagattgaattggtaaaaaagcagctggaaatggggaatgagacggtacttacgattgctaagacggtagacgctaaagatgtaaggacgagtcagcattctgagcgtgtggcagaatattccgtactgatcgcaaaagaacttgggtttgatgagaaaagctgtgaggatctgaaaaaggcagcacttttacatgatatcggaaagatcggtattcccgaccggattttaaataagccggggaaattaacggacgaggaatatggaattatgaaatcgcatgtgacgaaaggtgcggagatcttaaaaagtttcacgatcgtagaccatgtggaagagggtgccttatatcatcatgaaagatacgatggaaaaggatatgtgcacgggttaaaaggagaagaaatcccgatcaatgccagaattatcggaattgcagatacatttgatgcaatgacggcgaatcgcgtttaccggaaacagttggatatggcctatgtgatacaggaactgaaaaatggaaggggaacgcagtttgatccaggacttgtagatgttatgttaggactgattgacaatggaaagattgacatatgcagtctgtacaaagaacatacacatacagatcatagcagggaaaaagaggaggagtaaggtgaaaaaagtatatcttgtgacattgtgcacctgtctggttgtgattgctcttgtgtcggcatctgtatactttctgagagacgaagaaaaagagatcactgttggttttgtgtatgttggagatgcgagtaccgcatataccagcaattttattgatgcgcaggaggcaatccagacaaaatacggggatcaggtaaaagtcattgcactcaataatgttgcggagggaacggaaagggagtacttacagcagcttgtggatgccgggtgtgacctgatttttacgaccagttataattatggaaccgttacgaaggagtttgcagaaaaatatcccgggatcgagttttgtatggcaacatgtgcgaatgcaaatgaagaacctgttttaaaaaattatcatacatttatgggaaaaatttatcagggaagatatacggcgggagtggcagccgggatgaaaatgaaagaattgatcaaagaaggcgtgatcacagagcagcaggcaaagatcggatatgttgcagcctatccttatgcggaggtgatctccggatatacggcatttttgctcggagtgagatcagtcgtaccggatgcggtgatgacagtgcgttataccaataaatggaatgattatcggacggaaaaaaagtatgccaaaggcctgatcgatgagggctgtgtgatcatatcacagcattcggatactgcaggcccggctaccgcgtgtgaggaaactgctgcggggaccccggtttatctggtaagttataatcagagtatggaagatgtggcgccgaccacttatctcaccggatgcaagatcaactgggaaccctatatgatgggagctgtggatgcagttttaaacgaccgtgtgattgagaaaagtatcaaaggaactgtcaatggaaatgatattggtgccggttttgaagaagactgggtgcagatgttagaattaaatgaaatcacggctgctgatggcacagcggaaaaaatgcaggaagtgatccggcagtttaagcaggggaaactggatgtgttccgtggagattatgtcggggcagatccggatgatccggacgatacctatgatctgaatcagggatatacggagaatgagtttgcgtctgcaccttcgtttcattatgtgctaaaagatgtgatccggatagaagaataggggattgtgagggaaaaagtcctgcggatgcagagcatatcgtatcgtattcgcaggacagtttatattttttttataaaataattagcactcacctcttgacagtgctaacaatcgggtgtataacacaaattgtaaacggaaaaagatataaataagagggaaaactcatgatggtccgccatcatttgatatagatgtccagtttggaccacaattgaataagagggaggaagaatatatgaacattcagaaatttacacagaagtccgtagaagcgatcaatgattgtgaaaaacttgcatatgaatatggcaatcaggaaatcgagcaggaacatctgcttgttgcattgctgcagcaggaagacggactgattttaaaattgatagaaaaaatggatatccagaaagagcatttcctggataacgccaaaaaacatctcgcagcaagggtaaaggtatccggcggtcaggtctatgtcggacaggacttaaataaagtgctgatccatgcggaggacgaggcaaagcagatgggagacgaatatgtttccgtagagcatttattccttgcactgttaaaatacccgaacaaggcgatgaaggagatcttcaaagagtacggaatcacgagagaccggtttttacaggcgctttcaaccgtgcgcggcaaccagcgtgtagtttcggacaatccggaagctacgtatgatactcttgaaaaatacggttatgatatggtagcgcgtgcgaaagagcagaaacttgatccggtcatcgggcgtgatgatgagatccgtaacgtggttcgcatcctttcccgtaagacgaaaaataacccggttctgatcggtgagcctggtgtaggtaagaccgcagtcgtagaggggcttgcacagcgtatcgtaaaaggggatgtgccggaaggcttaaaagacaaaaagttatttgcactggatatgggtgccctggtcgcaggtgcgaagtatcgtggtgaatttgaggagcgtttgaaagcagttttggatgatatcaaaaattctgacggacagatcatcctgtttatcgatgagctgcacacgatcgtcggagccggaaaaacggacggcgcaatggatgccggacagctgttaaaacctatgcttgcgcgtggtgaactgcattgtatcggtgcaacgacactcgatgagtaccgtgaatatattgaaaaagatgcagcgttagagcgaagattccagccggtcatggtggatgaaccgacggttgaggatacgatctccattctgcgtggtttaaaggagcgttacgaagtattccatggtgtaaagatcacagactctgcgttagtatcggcagcagtgctctcaaaccgttatatttccgaccgtttcctgccggataaagcgattgaccttgtggatgaggcatgtgctctgatcaagacagaacttgattccatgccgacagaacttgatgaattaaaccgtcgtgtcatgcagcttgagattgaggaaaccgcattaaagaaagaaacagacaggttaagccaggagcgtctcgctgacctgcagaaagaattggcagaactgcgcgatacgtttaatacgaaaaaagcgcagtgggaaaatgaaaagaaatcggtagaaaaagtccagaaactgcgtgaggagatcgagacagtcaaaaatgagatcaagaccgcacagcagaattatgatctggaaaaagcagcagaattgcagtatggcaaattaccgcagttagaaaaacagttggaagccgaagaagaggaagtaaaaaaccgtgatctttcactggtacatgaaaatgtcagcgaggaggagattgcacgtattatttcccgctggaccggtatcccggttgcaaaactgacggagagtgagagaaacaagacacttcatctcgatgaggaactgcacaaacgtgtcatcggacaggatgagggggtcacaaaggttacagaagcgatcatccgttccaaagcaggaatcaaagatccgacaaagccgatcggttcgttcctgttcttaggacctaccggtgttggtaagacggagctcgcgaaggcacttgcggcaagtctgtttgacgatgaatctaacatggtgcgtcttgatatgagtgagtatatggagaaatattctgtctcccgtttaatcggagcgcctccaggatatgttggatatgatgaaggtggacagcttaccgaggcagtccgcagaaaaccatattccgttgtactgtttgatgaggtggaaaaagcacatccggatgtattcaatgtgctgttacaggtacttgatgacggacgtatcaccgattcgcagggcaggactgtggactttaaaaacacgatcattattatgacgtcaaaccttggttcggcgcatctgctcgaaggaatcgacgacaacggagatatcaacccggagtgtgaagaggcagtcatgaatgaactgagaggacatttccgtccggaatttttgaaccgtctcgatgagatcatcatgttcaagccgctcacaaaaggcaatatcggcaacattatcaaccttctgatcacagatctcaacaaacgtctctctgaccgtgagatcacagtagagctgacagatgcggcaaagcagtatatcgtggacaacggatacgatccggtttacggtgcaagaccgttaaagcgtttcttacagaaacatgtggagacactttctgcaaaactgattcttgcagatgaggtaagggagggcgatacgatcctgattgacgtggaaggagaccatctgactgcgcgcgtaaagtgacagattgtggatggtagcgagagaatcagacaatgtgcctgaagagataattgcatagatacaaaatagaaaaagaaggactttatccccaaaacggatagagtccttttttcaatatttgtattttgaagatgaaggaacatgatgaggaagaaatctgaaaaattttgtttatttactgtgcactttgcgcagcaaaagcggtaactccacgatcagcatggcgatccagcctgcaagataggaatatggaagtgcctcaatgccaaggtgcattttaaagacgagaggtgcggcggcaagcacgcggatgcccatatttacaaaactgctgataagtgtgatctttaaatcgccgattccgcggaaatacccctggattccgtttgtgacagccggcaggacatacatcagggaaatcaggtgaaggtaaataacgccgtgaccgatgacttcctcatctttgataaagcagagcataaattctctggcaaataaaaagcagagtgcaaatacaataaacccgtatataatttcaagaatcataccgcagcggaatccttcccgcatgcggtctttttttccggcacctttattctgcgccattaaggcagtcatggcatgcgcaatattctgttccggtgtgtaggcaaagtcgtcaattctgtttacgatcgcaaatgcggctgcaaccgaaacacccatggtgttaacgattgcctggatgccgagttttccaagctgtacagttgcctgctgcaatgctgatgtccagccatatgcaatcgtgcgcattaagagtgagcggtcaaataccagccatttttttccgagtcttaataagggcacttttttctggatatagatgacacagaaaacgcagcataaggcttcactcagcacggtagataccgcgcagccgttgctgccggctttcaacacgacaacaaaaaacagatcccctaaaatatttaaaacggcactgatcatcagaaaataaagcggggtattgctgtcaccgagtgcacgcagtgtgctcgaaaaaaagttgtacagaaaagtaaagaccaatcctaaaaagatgatctgtaagtattctgttgtgagggataaaatacctgcatccgcctgcattaagatcaggatcggtcttgcaaacaggatacatgctgtggataagatcaacgaaaaaataacgccggagagcatggtggtactgatctggcggtgcagcgtgtcgtaatcttttgccccatactgcattcccattaaaatgctggcacccatgcacagtccgtttaaaaacaggatcatcagagtggaaatcggattgcagatgccgacagcggcaagtgcttcttttccgacaaaatgcccgacaatgatactgtctacggcattgtaggtaagctggaacaggttgccgagcacgagcgggatcgtaaagcggatcaggatcggcatgatttttccggtggtaagatctttggtcatagtggtaaaagtccttttatttgtaagataaattagttcaaaaaatatttcaactcttctgcgcgggcttcataatctgcaactccgagatcataaagatcctgttctaaggcagcatccttggaaaaagtactaagcggcatatggcggcttggtgcaaagataaaaacatagccttctttttctagccggcaggcaaggtcgatggatgcctgataattaatatgccggttgtcgatgctttggattgttttcggatatttatgcagcatatgtttatacagcgggcggtgtgcctctggtttttttacgaagttccttggatttgagaggataacgaccattttggtacagccttgttcgatcgcatggtgcagcggaatcgaatcggcaacaccgccgtcgtaatagtaacggtctcctacttttacaggacggcagaaaccaggcagggcgcagcttgccataacagcacggtagtcgtcacggacaatgtcgtatttggaaaaataagttgcccgcccggttgcggcatcggttgcaggcatataaaattcagccggattttccatgacggcagagtaatcaagcggatctgccccatcggaatttgtcagtgtcccgtaaatatactgcaggccaaataagtttccagtatgtactaaacttcgtacgcttaagtagcgcggatcccttagatgttccgtataaaaacggagattacgtccccgttgtcctgcaagataagacagcgtatttgcagcacccgcagatacgccgatgcagtaggaaaatgtgatatcatcgtctaaaaatttatccagaatgccggcactgtatgcgcatttcataccaccgccttctactacaagtcctgttttcatagtgttcctttctttgtattttgataggtgtcaaaatgagctcatggacattatactttatttactacaaatcgttcaataccaacataaacagatttgccggtgtttctgtttcaccggatggaagtatggaaagaaaggcttgtcagctgtaaaattcaaccgcagtttttgcagtacatgaattttattgataatttaccaaaacgttgttgctttttaaaatagaggatgataatataaatttaccaaaacgttttggtaactggacgcatgaaaagaaacaagagagaagatatacaggatgatatcggaaaactaagagcgagagaaagtatggaggtgtagaaatgtcattaaaaggacttatttttgatctggacggggtgatcgtatttacagatcagtatcattataaagcatggaaacagatggctgatgagaaaggtatttacttcgatcaggagatcaataaccggctgcgcggagtgagccgtatggatagtctggaaattattctggaaagatatgagggacatccgttaagcgatgaggataaacagaagatggcggaagagaagaatgatatttataaaaaacttttagagcagatgacaccggcagatgtcagtgatgaagtgaaagaaactttagatgagctgcatagaaggggttatctgctatcgatcggatcatcaagcaggaatgcaaaatatattcttgagagaacaggaattatcgacaaattcgatgcaatttcggatggaacaaatattaaaaaatccaaaccagatccggaagttttcttaaaagcagcagagtttcttggcttgaagccggaagagtgcggtgttgtggaagatgcatatgcgggaattgatgcagcagtttccggtcatatgacagcaattgcgatcggcgatgcggcaggttatgacaaagcagattataagctgtctgcttttaaagatttactggacattgcaaaataagaattacaagtaatgtaaacaggaaaaatatggatggaattgcttgctttgcagttggaatatcatgataaaatgtgataagatggttacaaaccactgaaaaatgtaatgcaatgggggatcatatggcgaaagacagaaagttatatctgaatgaaagaacgacgatacgtgatgtcgcacaggaggcaggagtatcactgactacggtatcccatgcactgaacggctataaagatgtgagtgaaaagaccagacagaaagtcatggaggtggcaagacgactggattatatgccggatgaggctggccgttcactaagaggcatacagaagaagacaattgcactgctgcttgccggggaattgccggaagaagatccgagcggtatgatgtatggacttacgagtgggatttataagattgcccagaaaatggagtatgaatttacgattcttacaatgccgacaaacaagcagataaaaatcagttttgggcagatctgcaagaaaaagaaactgactggaatcatagttgacgggctcgctatggatatgccgtactatgagcagattaaaaacagtgagattccctgcgtccttgtggatgttgcgctggaaagcgatcatgtatgtgaggtttccgttgataatgagaaagcatcttttgaagaagtagagcatcttattgagaatggatgccgtaatattgcaatgctttccggtaagaagacagcacaggtgtcagaacgcagagagtgtggatacaggcgtgcattagagaaatatggactccatatccgggaagaatggatcgaggattgtctgtttgatcagaaaacagcagttcaaaagtcaatagaattaaaaaaaagttatccggagattgatgcttttttttgtgtgagtgacggcgttgcgattggagcaattgaaggcatgggacagcttggagtgcgggtgccggatgatgtagcaatagcagggtttgatgattatacggtttcacagtatattcacggagggattacatcaattaagcagtatccttacaaaatgggcgtagcgtgtgcgaatacggtcatcagcatgattgaaggaaaccgtgtaccagactggatacccatggaatataaacttatgaaacgcgcatcaacaaagaaatgaacttgtgaaaattatataaaagtaaacaataaaattcgtgaaacatgatgaaaaaacaaaaaaatgtacaaaagacttgaaaaccaaaacgttttgggatatgattcgtttatcagttaccaaaacgttttagttttttactttatactaatgtttcaggaggaatacatatgaagaaaagatttgtatctattttacttgtggcagcaatgacagcttcccttgcagcatgcggtggctcaaacggcggtgataacagtgcgtcggcaaccgaaaagggaggaaagacagagagtgcatctgacggtggtgagatcacacttacaatcccgaccttcttcgtaggagaaaatgttggcgctgtatattttgaacctgccgttgagagatttaatgaggcaaacaaaggaaaatatcatattgaattagaagaagtcgttgaggcatcttatacagacaagatcagccagctggcacagtctgattcacttccggcactgatccagacacctaacatagaatggatcaagacagcaatgatcccgggaaaactgtattacccgatgaacgattttctggatgaacatccggagatcaaagagctttgcgtagatgcttctttggaatattgtacacaggagaacggtgatatcatcagtgtgccggcgatcacactttctaacacaggtttatactataactcagcactgtactcaccggagaaaacagtttcatccatgacaatggatgaatttatcagttctcttggtgacaacaaatttgcgttccagacagttgacaatgcatggacatcagcaatgttattaacggcattgatcgcaaatgaagatggcggtaaagaatggcttcgatcgaatgaaggaaccaaatgctacgattacacagagccggcattcgtaaatgctgtaacaaaattaacagagatctggaaaacaaatgcatccgctaacgcagttggtgcagcatatgcagacgcagccaatgcattcatgtctgatcaggcagccgttatctgcaatggcccctggatgaactccgaattcgtggacagtgcttctggtaactggtctaatggatttaacggagcggatgtaaaagcggattattatcctggcaatgtgtcaatctgtgatacaaaagtatttggcagatggacgcttaccaatggtggtacggatgaagagagagaatgtgcagaagcatttcttgcatttatttattcaaaagatgagttagagacatttgcacttacagagggatgccagataccgaatcttacctatagcgatgaatttctttcgaagttagatgaaaaaccattggtaaaacagcagaccgagttactgacatctgatacaaatatcgttcctaatgtattaactattatgcctgattccgtatcaagcagtgtatttggaaccaatcttgtgcagttagtaaatggacagatcactccggaagagttctgtgagactcttacaacaaaagccgctgaagctggtgacaaataatcaatgaaatcatggagggggagtcatttacggacaaattgattcccccttttctttcagaagattgccttctggatgcggaatttatctgaaaataatgaatatttctgaaaggaaagggaatattatgacaaaaaagaaaaaatatggaaaagtacaggttaaaaattttaaatggatttacgcattccttcttccgacaatcattatatttgtgatgttttatgtacagccgatcgttgtgatgcttacaacatcatttacaaaatgggatggatttaatgatcctgcttttaatgggatcagtaactatataaaactctttaccaacagtgcttctgcagcatcgatcaaaaacctgattttatggtcggttattgcaatgacgttccatgtaggatttggtgtgctcacagcatttgttttatatctgaaacctcacggatggaaattcacacgttctgtatttatgataccaaatattatttcagcagcagcgtgggcattgatctaccggtttattttcaatgaccagatgggtgttttaaactcagtgatacgtgtatttgataaagatttttcggtgcagtggttctaccagagtccatatgcattctgggcagttacccttacgtggctgttttatgcagttattgtcacattgattgtattgaatgatttaatggcgattccaaaagaactgatcgaagcagcaaaacttgacggagcgaatggatggcagctgatccgtttcgtggaacttccactttgccggatctccataggaaccggaatgttatgttctatcacatcacgtatctccatgtatgaagcgatcgcacttacgacagccggaggacctggtgatgatacgatgagtttatctgtactgctggtacgtgcgatcacagattacaactacggatttgccaatgcgatcggtgtgatcatgttcctgatcggtttactggttatgtacattgtaacaaaggcattccgtatgaatgattcaatctactaggaggaacaatcatgaatgtgataaaaaaaatattaacaaatatcctgatttatggaacagaattcattgttattatgctgagtgtattcccaatcgtatgggtggcattatcctcctttaaaacgaatgcacagattctggagggaccatttacactgccaacaggtattacaacagcgaaagaggcatacacatatctgttccagaaatatgatttctttagttattttggcaattcgctgatgatatcgctgatatctacggtaatatccctggtctgttttgcaatggcggcctatgtattggcgaaatatgagttcccgggaagaaatcttatttttgcactatttacaattacaatgcttgttccgggtcatgcaaaagcacagccgattttttcactgatcaattccatgcatctgtatgataccaaaacaggtttgatccttgtatatctgggaagcggtattgcaatgtcaattttcattttgaaatcggcatttatgggagtcccaaaagaattggatgaggctgctacgattgatggtgcagggtttttccgtacattttttatgatcaatcttccacttgcaaaatcaggtctctctaccgctggaattttaatgtttctcggcaattggaatgaatatttctatgcagcacttcttacatcatcagagaagaacaggacgctgccggttgcattacagttttttaaccagtcattatcgtacgattacacgaaaatgtttgcggcactcacactcgtagtggttccggcgatcattgtatattgctttgcacaggagcaggtacaggaatctgttgctgcatccggaattaaaggttaataaaggagaatgaagctatgccagttatgaattacagaaaagggacagaaaaagaaaaaagctggattattgaagaaaccagtttcaatgagaaatatacaggaaaatgtgaatctgttttcacacagggaaatggatatttaggactccgcaattctctcgaagaacaatatgtgaataccgtaaggggtatgtttattacaggaacattcaataaagcaagtaaagatgaagtaacagaactgccgaatgtttcggatattgtgaacatggagatcgaactcaatggggaacgtttttccatgaatgagaacaatataaaagagtattcaagaacattaaacctctatacaggagaaacctgccgcaacgttttatggaaagggaaaaatggagatatcgtacatctttcattccaccgttttgtatcttatgaaaatgtgcatgtgatcggtgcatatgttgaaatcaagccggtaaactgcgagatgaaagtaaaagttgtaagcggaattgatgcacaggtaacaaatcatggggcacagcatctcacagaattttccaagcgtgcatttgaagaaaaatttcttcaaatgggtatggtcacgacagaatcggcagtttcaattgcagtcagcaccgtacataaagtattccagagcggaaagtatacagaagatgcggcatctaagatcattgatgaccgaagaaaaatccacactgaaattcagcttgtcattccacagggagagaccgcaagagtggagaagatctcaacggttcattctagcagagatctggagtatgtggcatcagggaaagagccggaaggagagaatgtctgcagggatggtcttgataatttaaaagaagcagaagaaaaaggctatgaaactcttttggagggaagtaaaaaagtctgggagaaaatctggaagaaacaggacattcagattgatagtaaagaagatgatgcacagatagcggtgcgttttgcactttatcatcttcagatcatggtgcgcagtgaagataaccgggttggtattggtgcgaaggcacttagtggagaaggatataaaggacattctttctgggatacagagacatttattttcccatatttccagatggcagaaccgaagacggcaagaacccttctggaattccgttataagggactgtacggtgcaagaaagaaagcaatcgaaaatggttacaaaggagccatgtacccgtgggaagcggcatgggtcagtgatggtgaagttacaccgtatgtgaccggtgtcaatgttcataccggagagccgatgatctgtttaaccggagtgattgagcagcacattacgtctgatattatttttgcactgtggcagtattatgctgcaacagatgatcaggacttcatggatagatatggctatgagatgacgatcgagactgccagattctggaacagccgtctggagtggattgaagaaaacaacagatatgaaattcgtgatgttataggaccggatgagtacaaagaacatgtggataataatgcatatacgaattatatggcacatgaaaatatgagacttgcagcacaggtaattgcatgcatccgtgatgagaagaaagatatctacgggaaaatgcagaaattaatgcaggaagagggtacatcattagaacagttagaggaagaactgaaagataaaatgaagaaactttatctgccgcagccggatgaaaaaacagggattattcctcagtttgacggatactttgatctaaaagaaatagatctttctgtgtataagaatgcatctgttgtgggaacgatctttcatgattattcaggggaagatgtacagggaatgcaggcaggtaaacaggctgatattgtagaactgctgtatcagatggaagatatcacgacaccggataataaggcaaagaactatgtatactatgaagcaagaacactgcatgattcatctctttccaaggcaatccacagtatcactgcatgtgaccttggtatggagaaagaggcttatgaaatgttcatgagtgctgcacttaccgatcttggacaggagatgaaatcctctgatgcaggaatccacagtgcaaatatgggaggtgtatggcaggatgtggtaatgggattcggtggaataagaatccgtgacggtcatctccgtattgctccaaattgtccaaaacagtgggagaagtttacatatcctctttactggaaaggaaacgaacttcatatcacagtctgcaaagatggtgtggaagttataaacgaaggggaagatttcgaggcagagatcatggatcagagagtaactgtcagcaaaggaaaaaacgaatttcgggcataagagcataggagagaaaaatgctgcagaatgatggaaagtttgtaaaggtattaaaccggatcgcagatctggttggattaaatcttttagcaatcctcttttgtattccgatcgttacgataggggcatccataacagccgtttatggatgcatctttcgcatacaggagaaaaaagaaggatatctgataaaggatttttggaagttgtttaaagcaagtttcaggtcatctacgatcatttatcttgtgggtgtactggtgattgcaatgctatatctggattatcatatttttgctgcagacagaacgatgaatgctttacagatacttgtaatcgcagccgggatcatagtagcagagatttttacttacgcgtttccaatggaatcttactttgagaatactgtgaaagcaactgtgaggaatgccgtattgctcggaatctcgaatattccatatacattgcttatgctgggtttgaatacccttccattttttattatttcaaaaattccaattgcatttggtatctggtttctgatcggtatctcaggaattgcatggatcaacagttttttcttaaagaagatttttcaaaatgtaaaaatacgaaaggatgtgtaatagacgatgaaacagcagtttatatgtgaaagaagaccaaaagcagatccgcggaatattgttcttggaaaaaattaccgtattacatttctgacggacaggctggtcagatttgaatataatgaatccggtgcatttgtggatgaggcttcgcaggtaatatggtacagggatttagaagaggttccttttgagataaagcagaaaaataactttctggagatccagacaaaaagcatacggatacgctatgatgagagagcatttgatgagagcatcctgagtgtgaagctgaaaaaaccggacaatggatgtgatctggaatggtattatggcagaaaagaggatcgtaatcttttcggaactgcccgtacgctcgatgaagcagacggcaggatcagactggaaaaaggaattctttccagggatggatttgcagtattagatgattcaaaaacgattttacttaccgaggatggctggatcaaagagagaaaacagggaggagaggatttctatctgtttgcctatggtcatgattaccggggcgcggtaaaagatttttttagggttaccggccgtgtcccaatgcttccaaaatatgcacttggaaactggtggagcagatattacgagtattcacaggatgagtatcagagactgatggatcgtttcttagcggagaaaatcccgttttcggtggcagtcattgacatggactggcatatcacagatattgacaagaagtatggttccggctggaccggttatacatggaacagagatctgtttccggatccagtgagttttatggataatctgcatgacaggggaatgaaagtgactttaaatgtgcatccggcactcggtatccgggaatgcgaaagtatgtataaagaaatggcagaggcaatgggaatggatccggcagcaggagaaccggttgaattcgatattacagatccggagtttctggaaaattattttgagatcgtacatcatccgcttgaggaagagggagttgatttctggtggctggactggcagcagggtggacatacggcagtgaaagagttagatccgctttggatgctgaatcattaccattatcttgacagtggacgggatggaaaaagaaaaatgacattttcacgttatgcaggtcctggttctcacagatatccggtaggtttttccggggatacggttgtaacgtgggagtctcttgatttccagccttattttacagcaacggcatcaaatatcggatatggatggtggagtcatgatataggcggacatatgcttggaatccggtcagatgttatggaggcacgctggtatgagttagggacattttccccgatcaacaggctgcacagtactaaaatgtcgttcagtggaaaagaaccatggaatttcagaccggaagtagaacatgcgatgggagaagccctgcgcttaaggcaccagttactgccttatctttacactatgaactatctggcatacaaagaataccgcccggtcattgcaccaatgtattacgattatccggaaaaggaacaggcatatccggttcaggatcattcttttgttgagggagtaagcaacaaccagtatctttttggaacagatatgattgttgcaccgattacaagtgaccagatagcgagtttaaatcagggaaaagtaaaagcgtggataccggaaggctgttaccacgatttctttaccggattgatctataaaggtgagaaagtaatgtggatgttccgcggcattaacagtattccggtgcttgtaaaagcaggaggcatcattccgatgcagaaagaactgttcggaaaagattttctgaaaaatccggaagaacttatcataagagtctatggcggagcggatggcaattatacacattatgaggatgacggtgaaaccgaggattataaagatggcaggagctgttgctttacatccatgcattttgactgggaaagaggggcgttcacaatcgaaggggcggccggacagacagatctgatcccggaattccgggattatacagtggaactgtgtggagtgaaagaggcagtgcctaaagtatacataagtggaaaaaaaatcaaaataacgtatgaatatcagtggaagaagggatgtatcagaatccacattccgaaagtgtcagtggatgaaaaagtggaaattgtttttgaacagaaactgacattaaatgacaaccatacactggagcgtgtgtatgatctgctgaatcaggcacaggacagtaatcttgcaaaagagtctgcataccggcttttaagtagtggaaaaaatctggcagatatcttaggcgagcttgagacgacgaatttaaaaaaagagatcagactggcagtcattgagatcatgaccgctgatttataaggagaaaaaagatgcagaaagcatggtggaaagaagcagttgtttatcagatttatccaaggagttttatggatagtaacggagatggaatcggagaccttcaggggatcataaaaaaattagactatataaagaatctcggtatcacagttatctgggtatccccgatctataaatctccaaataaagataacggatatgatatcagcgattatcaggatataatggatgagttcgggacaatggaagattttgatgaattattaaaagaaattcatcaaagaggaatgaaactggtaatggatctggttgtcaaccatacatctgaccagcataaatggtttctggaaagcagaaaatcaaaagataataaataccgcgattattatatctggaaagatccggtagatggtcatgaaccgacaaactggggatcatatttcagtggatctgcatggcagtttgatgagacaaccggacagtattatctgcatcagtttgtgccggaacagcctgatcttaactgggataatcctgtggtaagaaaagaagtttttgatatgatgacatggtggtgtgaaaaaggcattgacggattccggatggatgtgatcagtctgatcagcaagccggaagaatacaaagatggtccggtaaaagaaggggaaaaatattctttttgtggtgcagtcacagccaatggacctcatgaacatgaatatcttcaggagatgaaccaaaaagtattaagcaggtataaccttctgacagtgggtgaaacatcatgcgttacgctcgaagaggcaaaaaaatatgcgcgaagcgatggaaaagagttaagcatggtattccagtttgagcatatggatgtggattcggatgaacatggaaagtggacagataagaaactttatcttccggatctcaaagaagttttaaaccgctggcagaaagggttagaggaagtagcatggaacagtctgtactggaacaatcatgaccagccaagggttgtttcgagatggggaaatgattccggggaatacagggagctttcagcaaagatgcttgcaacctgtctccacatgatgcagggaacaccgtatgtatatcagggggaagaacttggaatgaccaatatgcatttttcggatgtgtctgaatgtgacgatatagaagaaaaaaatatttatatagatcttgttaccgatacaaaagtatatacgcatgatcagatgatggacattatcagtaagaaaggacgggataatgcaaggacacctatgcagtgggatgattcagaaaatgcaggatttaccacgggaacgccatggtttgccgtgaatccgaattataaaacgatcaatgcggctgctcaggtggaagatccggattccatatacaattactacaggaaactcatagaactgcgcaaagaggaagaagtgatcgtttatggaacgttcgacggacttgaagatgcagatgaaaatctttacatttatacaagatcatccgagaataaaaaaatactggtaatctgcaatttcacggaaaaagaactggatgttccggcttctattgcggatatggtaaaagaaaaccggggaattctgataggaaactataaagatatttcagaaaaaatccgtccgtatgaagcggtagtatacctgacaaaataggataatttacgaaaaaaaacgaaaaaaatagctggacgaactgaaaagggagaggtatactaggcgggtaacaggatgattctttgaacagacagggctattaaggatgtatggtatcgatgaaaagaaagattggttctacttattttaatgatgaattggtatatgacggtaacgatctgggggctgtatatacaaaagaaaagacaacatttcgtatatggacacctgctgccgggaaagtatcgcttaacctatatgagcagggcgatggtgacaatttgatagaaacaattccaatgacagcagatgtcaaaggaacctgggtgtgtgaaaagacaggagacctgaatggtgtatattatacttattcagtacagatcggtaataaagtaaatgaagttgttgatttatatgcaagaagtgcaggcgtaaatggcaacagaggtgagatccttgatctgcaagctgccgatccggatggatttgatgcagatgtcagaccggcatttaataatgctacagatgcagtgatttatgaagtacatattcgtgatctgtcttccgatgcttcttccgggattcggaatgcaggtaagtttcttggactgacagagcgcggaacaaagaacagggaagggctggctacaggacttgatcatattctggatcttggagtgactcacgtacagattctgccgagctttgattatgctacggtagacgaaacaaaacccgacacagcgcagttcaactggggctatgatcctaagaactataatgtgccggaaggttcttacagtacagatccatatcatggggaagtacgtgtcaatgaaatgaagcagatgattaagacacttcatgaaaatggaatccgcgtgaatatggatgttgtatataatcatacttatcatctggcagattcatggtttcagaagacagtgccagattattactacagaaagaatggcaatcattattcagatggttcaggctgtggtaatgaaacagcctcggagcgtgccatgatgcgcaagtatatcgtagattctgttgtatactgggcaacggaatatcatatagatggtttccgttttgacttgatgggcgtacatgatctggataccatgaaggctgtcagaaaagcactggatcaggtgaatcctgacattatggtatatggtgaaggatggactggaggagaatctgcattgccggcagcacagcaggcaacgaagaacaatatttaccggctggatcgtgtgggtgctttcagtgatgatatccgtgatgggatcaaaggcagtgtatttgattttctggacaaaggttttgtaagcggcaaagatgatatggaagaaaacattaaattcagtgttgtagcagcaaccccgcattcgcaggttacgctcacaaaggccggtgataagtgtacgaactggtcgggacagccgggacagagtattaattatatatcctgtcatgataatctgacattctgggataagcttgccatttccaatgcagatgacagtgaggctgacagagtgaagatgaataagctgggaagcgcggttctttttacctcgcagggtgtaccatttatgcaggctggtgaagagatgcttcgctctaagccaaatgagaagtctgagactggatttgatgagaacagctattcttcccctgatgcaacgaacagcattaagtgggataataaaggtaacgtaatggatgtttatgaatattataaaggtctgatcgcattccgtaaggcacacagtgcactgcgcatgacaacagccgctgcaattcagaataatcttacctttatgactggacttgatgcaaatgtcgtagcatataccattcagggtgaggtacagggagaaacggcacagaatattgcagtcatctataatggaaatccggatgcagtcacagtaaacttacctgccgggacgtgggatatctgtgtcaatggtaaaaaggcaggatgcagatctcttggaacggcggaaggttctgttactgtcgaaagtatctctgcgctggttctggtacaggaagatgataccgtaaacaaagtgccggcagaggatgcataggcagacacggcagtcagatagacaaagagagaaaattgtatgagattgtatgagatgtgcgaaaaaaattgaatatttatcagggagacgatataatagaatgcggaggaaacaaagcatgtcatttacgcatctgcacgtccatacagagtacagccttttggacggttcaaataagataaaagaatatgtttcaagagtcaaagaactcgggatgaacagcgccgccatcacagatcatggtgtgatgtacggcgtgattgatttttataaggcagcaagggcagcagggattaagccggttttaggctgcgaggtctatgtggcgccgggatcacggtttgacagggaactttcacacggggatgaccgttattatcatctggtgcttttagcggaaaataatcaggggtatcagaacctgatgaaaatagtttcaaaaggtttcgtggaaggatattactacaaaccacgcgtggatatggaagtcttagagacgtatcatgagggtatcattgccttaagtgcctgtcttgccggggaggtgcagcgctacctggtgcgtggtctttatgaggaggcaaaagagactgcctgtaaatatgaaaaatgttttggaaaaggcaatttctttttggaattgcaggatcatggaatcccggatcaaaagaccgttaatgcaggtctgatgcggatgagtgaggagacgggtattgagctggtggcaacaaacgacgtacattacacttacgctgaggatgccgagccgcatgatattttactctgtctgcagacaggaaaaaaactgtccgatgaaaaccgcatgcgttatgagggcgggcagtattttgtgaaatctgaggaggagatgcgcgcgctgtttccatatgcggcacaggcgattgacaacacacagaagatcgcggaccgctgcaatgtggagattgaatttggagtgaccaagctgccgcattttgacgtgccggaggggtatgattcgtggacttacctgaacaaactctgtcatgaggggctggtaagacgttacccggacaagcatgaggagcttttgccgaagcttgactatgagctttctgtcatccagaagatggggtatgtcgattatttcctgatcgtgtgggattttatcaactatgcgagaacacacggcattccggttggtcctggaaggggaagtgcggcgggaagccttgtgtcttatacaacgggtattaccaatattgatccgatccgttataacctgctgtttgagcggttcttaaatccggaacgtgtgaccatgccagatatcgatattgacttctgctatgagagacgaagtgaagtcattgattacgttatcgagaaatacggaaaagactgtgtaacgcagatcgttaccttcggtacgttagcggcgcgcggtgtcatccgtgatgtcggacgtgtcatggatctgccgtataatttctgtgatacgattgcaaaaaatattccaaacgaactcaatatcacgatcgacaaagcactcataatgaacccggaactgcgttccatgtatgagtcggatgagacggtaaaaagactgatcgacatggcgaaaagactagaaggtctgccgcgccatacctccatgcatgccgccggagtcgtaatctcccagaaggcgatggacgaatatgtgcctctgtcgagaagttccgatggcacgatcacaacacagtttgtcatgactacgatcgaggaactcggacttttaaaaatggatttccttggactgcgtaccttaactgtcatcagtgatgcagtcaaacttgtggaaaaaaatcatggaataaaaattgatgtggataacattgattatgatgataaaaaagtattagactcgatcggaaccggaaaatgtgatggtatcttccagttagaaagtgcgggtatgaaaaactttatgaaggagttaaaaccgcagagtttagaggatgttatcgccggcatttccctttaccgtccgggaccgatggattttatcccgaaatatatcaagggaaaaaatgaaccggagagtgtaacctatgtctgcaaggaattagagccgatcttagagccgacctatggctgtatcgtctatcaggaacaggttatgcagatcgtacagaaccttgccggttatacaatgggacaggcagataacatccgccgtgccatgagtaaaaagaagcagtatgtcattgacgcggagcgtcagaattttgtttatggaaatgaagaacagggcatcaagggctgtatcgcaaatgggatcagtgagcaggcagcaaaccagatctacgattccatggttgattttgcaaaatatgcgttcaataaatcacatgcagccgcttatgcagtggttgcctatcagacggcatatttaaaatactattatccggttgagtttatggcagcactcatgacgtcagtgatcgataatacaagaaaagtcgccgagtacatttattcctgccgtcagatggggatcaaagtgctttccccggatatcaatgagggagaaggacgctttttggcaacaaaagatgggatccgctacggcatgtatgcgatcaagagtatcggcagacaggtcattgatatcattttagcagaaagagaggcaaacggtaaatatatcacactttctgattttttaagccgtgttgccgggcgggaggtcaataagcgtgcggtcgaaaacctgatcaaagctggagcctgcgatggattagacggcaacagacagcagatgctcttagtatataatacgctgatcgacaacctgaaccaggaaaagaaaaattcacttgcagggcagatgtctttgtttgaccttgtctcagaggaagaaaaaaaggcgtatgaagtccgtttcccgaatgtggaggagtacaccaaggagatcaaacttggttttgagaaggaggtccttggcatttatttaagcggacatccgttggaggaatatgaggaaaaatggcgcaaaaatatcagtgccgtgacggcagattttatgctggatgaagaaacaaatgcggtaaagattaaagataaccagagtgttgtcatcggcggtatcattaccgaaaagacgatcaaatacacaaagcagaataaagcgatggcatttatcacgatcgaggatctgtttggaactgtggaagttatcattttcccgcgcgattacgagaaatacagccgttatttgaacgaggatgaaaaagtctttgtcgccggacatgccaatgtcgaggaagataaaaacggaaaactgatctgtgaaaaaatctattcctttgacgacaccaaacgggagctgtggcttcagtttgcgacaaaagaatcatatgaggaaaaggaaaaagaactgtattcccggctctatggttcggacggaaatgatgagattgtgatctatattgcctcgccgcgtgccatgaaaagattaggccaaaattacaatattcatatcaatccggagcttgtcggtaacttgacggaatttttgggcgaaaaaaatgtaaaaattgttgaaaagagcattgaaaagaaataataaagagattagaataataaagattagaaaaatgggtatattattttaggagggaacgataaatggcaaaagagattaatacaatcggtgtgctgacaagtggtggcgatgcgccgggaatgaacgcagccattcgtgcagttgtaagggaagcaattgcaaagggaaaaaaggtaaaaggaattaagcgaggttacgcaggacttcttcaggaagagatcattgatatggaagcaaaagatgtttccgatatcatccagcgcggtggtacgatcttacagacagcacgctgtatggagtttacaacagcagaaggacagcagcgtggtgcagagatctgtaagaaacatggcatcgacggaatcattgttatcggtggtgacggttctttcaagggagctcagaagcttgcgggacttggaatcaataccattggtcttccgggaaccatcgaccttgatattgcatgtaccgagtacacgattggatttgatacagcagtaaatacagcaatggaagcaatcgacaaagttcgtgatacatcaacctcccatgagcgttgcagtatcatcgaggttatgggacgtggcgctggttatatcgcattatggtgcggtattgcaaacggtgctgaggatattttacttccggaaaaatatgactatgacgagcagaaattagtcaaccacatcatcgagaaccgtaaacgcggtaaacagcatcatatcatcgtaaatgctgagggaatcggacattcttccagtatggcaaagagaatcgaagctgcaaccggtatcgagacacgtgcaaccatcttaggtcacatgcagcgtggtggaagcccgacatgtaaagatcgtgtatatgcgtctaccatgggtgccttagcagtagacttactctgcgaaggaaagacaaaccgtgtagttggataccgtcatggtgatttcgttgattatgatatcgacgaggcacttgcaatgaaaaaagagattccggaatatcagtacgagatcagcaagaacctttctctgtaatctgattttacatagaatcatatatttttgcattttagagagaaatccgttatacttagcgacaggtataacggattttttagtgagggaaattatgattacaagtacatcaaaccagcagatgaaaaatttgacactgctcatgaaaaaagcaaaagccagaaatgaacagggtgtttttgtggcagagggaagaaaaatgtttttagaggccccggtggagtgggtgaaacaggtttatgtttccgagagtttttatggaacatgtacgcagggcaatatgcaggattgcatggaatcctgcacgccaaaacatggggaagaaaaactgaacagaaaagtactggagcgtttgaatgaaaccggctatgagatcgtctctgacaatgtgtttaaaagtgtttccgacacacagacaccgcagggaattctctgtgtgataaagaaaccggagtatgcattagaggaaatgctcaaaggggaacagacacatcttctgatcttagagagcatccaggatccgggaaatctcggcacgatggtgcgcaccggtgagggggcaggcatcacgggtgtgatcatgaaccagacgaccgtggatctgtttaatccgaaaacaatccgttccacgatgggaagcatttatcgtgttccttttttcgtcacgaaagatcttcctgggacgatttcatcactcaaagagcagcaggtcaatgtctatgcggcgcaccttaagggtatgctttcctatgatgagccggactataagaaaaagacggcgtttctcatcggaaatgagggaaacggattgtcggatgagatcgcagatttagcagatacttatattaagattccaatgcagggacaggtggagtcgttgaatgcggcgatctctgcatcacttctgatgtatgagacgggacggcagagaagacactgattaacgataaaaatggagagataacaattcatgagaatctggtttaaaatgatgaagggtacccacctgatcaaggatatgacagtgacagatgagtcagatgatacgagaacacacaaaattttcaaggcgttagatgaggtatgttatgcatttgaccttggaaaaccgatctggttagatgcgaatgtggaagagtttaagaggcatgcaaagacacgttttacgcaggattgttttattgagcatgtggattttgattttctggagatgcatgtgatcgaggaggattaaagggagaacatcccaatatggaggacatgttgtatggcgctggaaaataagcttggaattaaaagttccgcagaactcgcgcgtgaagaggaacgtatcagtaaaaagaaggcagtagaactgtttgaaaatggtatgctcgagaaacttgaggcgggaaagtttcaaacgttatgtgggattcataaatatttatttgatgatatctatgactttgcaggaaaaatccgaaccgtaaatatatcaaaaggcaatttcagatttgcaccgcttatgtatcttgaaacagcaattaaaaatgtagacaaaatgccacagaacacatttgatgagattgttgaaaaatatgtggaaatgaacattgtgcatccgttccgtgaaggaaatggaagaagcatgcgcatctggctggatatgatgttaaaaaaacagatcggacaggtagtagactggagtaagatagaaaaagaagactatctgatggcgatggaacgcagtccgatcaaagatattgaaattaaatatattttaaatgcagcacttaccgatcagatcaatgaccgggaaatttatatgaaaggtattgaccatagttattattatgagggatatgtcacgtataagacggaagagttgtagggtggctggcttatgaaaaggcaagggagagatctcttgccttttggttatttatgtcagattatgaaatagaaaaataaatattttacgttaatatatgaaaatttggaagatgcatgttacaatagtaagtaaataaaatataaaggcataaaataacagatggagaaggggaatgttagcaaaattagaattaaagttaaaatgtgaaaaagaactgacatatcagatgtcatcattgtttcatggggcacttatggaattgctgccagaggaatatgcagattatctgcatatttcaagccttcatccatatgcacagcatttagaatgcagagagggggactggtactggataattacagggctcaataaggaagcagtgcagattattatacatgatacgttgtggaaattagaatacattctgataaaaaaacatgatcttaaagttttgatagtgaagaaaaattatatggaaacaacatataaagaattaatggatcatttttatgaggatgatgggaaaaggtatattcagattcattttctatctccgactgcatttaaacaaaatggaaggtatcttttttatccggatcttcgctgtgtttttcagagtctgatgaataagtacgacagtgccacagcagaaaatacaatgcatgatgaagatacactcgaacagatatgtgagcatgcacaggtgatcaggtatgatctgaaaagtgtaagtttttctttggagggggtcaagattccatcctttatcggaaaaataaccataaagctgcatggcacagatacaatggcaaattttgttaacatgttgttcgagtttggagagtattccggggtaggaatcaaaacttccctcggaatgggatatatgaaaatcataaacgaagggggaagaaaatgataacggacgatcagataaaattaatgattggaagtctgcttcatgacataggaaaagttgtgtatagaagtggggatggaagaaaccacagtcagagtggatatgagtatctgaagaatgaagcacatatttcagatgatgaaattttaaactgtgtgagatatcatcatggaatgtatttaaagaacgcatcattagcagaagacgataaggcgtatgttgtttactatgcagacaatgtggcagcattttcggatcgcagagaggcggaagcaggagaaggcggattcgataaagcgatgccgttagagagtgtatttaatattttaaatggaaatcacggacaaagtcattatgccatgcgggttttaaatccaaagaatggaattaattatccgacagaagatgaaatatctatggatgaacatttttatcagtccgttattcaaaatattacagataatttaaggggaattacgttagacgaagaatatatcaattccctgctggctgtgcttgaggcaaatctgacatacattccatcttctacttcaaaaaaggagcttgcagatatttctttgtatgaccacatgaagatgaccgcagcagttgcgtcatgtgtaatgcagtttctgactgcgaaaggcgaaaaaaattataagcagcgcctgtttataaatgcagagaaattttatgacgaggaaatgtttttgctgtattccatggatatttccggtattcagaattttatctatacgataggagaaaaaggtgcattaaaaggactgcgtgcgagaagtttttaccttgaaattatgatggagcatattgtggatgaactgttagagaagctgtcactttcaagggcaaatttaatttatacaggagggggacactgctatttgcttttagcgaatacggatgatacccgtgatattttagagcactatgaaaaaagtctgaatcactggatgatggaacattttgatacagcgttatatgttgcctgcggatatgcgaaagcaaatgccaatgcgttaagaaatatgccgaacggaagttattccgatctttatctaacgatatcaaagatgatttctgagaaaaaatcgaatcggtataatgcagatataatccgtagtctgaatagcagaaaacatgaaggagagcgggaatgtaaagtgtgccgcagaatagcccgccttatagatgataaatgtccggtatgtctggcattagagaaaatgtcgggaagtattctgtatgaaaactattttactgtaatgagtgaaccggacaaagatgcgctgccacttccggaaaacaggtacttagcagcagatacaaaagagagcctgctaaaacggatggaatcagaaaattatgtccggtgttatacgaaaaatgaaatttatatcgggaaacatgttactaccaaattgtgggttggagattatacgacaggtgacacgtttgaaaaactggcagaacaggcagaaggtgtggaaagaattggaatccttcgtgcggatgtggataaccttggaacgacttttgtttatggactgcagagaccggatggagatgacaaatatgtaacactttcgagaacatctacattgtcacggcagttgtctttattttttaaatgttatatcaatgagatacttcggaaaggaacagcagacaattttggtggaagtggggaacgaaaagcggtaattgtatattctggtggagatgatgtgtttttagccggagcgtggaatgatgtgatcgcagcttttatggatatcagaaatgcgcttgaaaaatttacacagggaacgctgacaatatcaggaggtgttggtatttacgatgcaaaatatccgctgaatgttatggcaaaagaagtggaaagacttgaagacagatcaaaacatgtggaaggaaaaaatgcagttaccctgtttgatgaaacacatgcttatccatggaatgtatttatacaaaatgttgttacagaaaagttaggtgtgcttaagacttattttgatcagaatgatgaacacggtatggcatttttatatcatctcatggaattgttaagggaaagtggaaacgacatcaattttgcaagatatgtttatctgttatcaagaatggaaccacaggaacatgaaaataaagaaaaacgggcggcttaccggagtttttcaaaaaagatgtacgagtggagcgggaaagaacaggatagaaaagaactgatcatggcaatctatctgtatgtatatctgaatcgcaaaagagaggagcaggattaaatgaaattgacagaagaaaattatgtggggattgcagaacaggcaatcaaggagctgtgcagtgaaaaagaccagaaagggagactggttggtccggtaacaacatccaagatcagaaatctgctttccatgacatccgatatttataatgatgtggtcaatagtcagagcgacaagctgaatgcagaaataattggacggatcaactacatgaagattcgttttatctatgaagcagggcgtgaaccgaaggtaaagaaactggtagataaagcaaagattttagagcacttagaagagatcaaaggcagcagagaccagtatattttattcagccggtatatggaagccttggttgcatatagaaaattttatggtggacgtgatgagtagagggaggatgaaataatgtttgcaaaagttaagatcagtggggtgttagagacagtaacgggtttacatattggcggatcgagtgctttttctgcgattggtgcagtagattctcctgtcatccgggatgcaaggacgaatatgccgatgattccgggtagcagtttaaaagggaaattaaggacacttctggcaaaaaaatataatcagacagtagcgaaaacaccggatgaggatgcggtatgtctgacaagtctgtttggaagtgcgaaaaaaggtcaggtaaagactagtaaaatcctgtttaacgatatgtttcttgaaaatatggatgaattaaaatatgcagggctgacaggtgcaacagaggttaaatttgaaaacagcatccaaagaacaacggcagtagcgaaccccagacagatcgaacgtgtggtaagaggagcaaaatttccgatgcagttgatttatgaagtgacggatgaatcggaaatggttcatgattttgaaatattaaaagacgggtttaaacttttagaatatgattatttaggcggcagtggatcaagaggttatggacgtgtcaaaatcatggatatccatgtggaacctgtgataggggaagtgtcggaagatgttttgtcccagtgtcagaaaatcatgagtgtagtggaataaaataactttgcaggattgatttttgactacagagagaaaagaaatgaggcgggacatggaatatacgatctatcagttagaatttaaaacaggtgttcattttggtaccggaatgttaaatgaaagtgcctgcacgtttaaggcagatcagatattttcagcactttatatagaggctttaaaactgaatctgcagcagcagttatatgatgctgtgaaaaaaggaaatctgttaatttcagatgcatttccatatattggacagcagtatatgattccaaaaccgatgatatatgtggagccggtaaaccgtggggaatcgaagcagaaaaaagcatataaaaaaatgaagtttattccggtagaatgtttgatcgattttctgaatgggaaaatggatctgtcaaatgatccgatggaacattatggacattattttcagcagacgatggcggctgtccgcaccggcgaggagactctcccgtacagggttggaactttttattatgaagagggatgtggtttgtatatcattgctgcgtatcagggcaaaaatgaaaaatgtcttatggaaaaactgctgacggcattatcttatacaggaattggcggaaaaaaatcaggtggacttggtaaatttcaatacgatgagaaacagattccaggaaaacttttagagagcctgcagaaaaaatcggacagatatatgttattgtcagttgcacttccggcggatgatgagttggaaaatgcgctggaaaatgcatcctatctgttagaaaaaagatccggatttgttgcgtcttcgaattatgcagaggaatggagaaaaaagagggatctttatgtatttacagcaggttcctgttttgtaaattgttttgccggagatatctatgatgtgtcggaaggcggaaaacatcctgtgtatcgatatgcaaagccgatttttatgggggtatcattatgagggattatttaaaacactaccgggtgaaaatatgtgtattatccccagtctatataggttccggtgaaaaaataggaaaaaaagagcacatctatatgccatggaatcatcatgtgatcataccgaatgtagagaagatgtacatggatctgcagaaaaaaggactcggaaaagagtttgcagactatatgatggatgggcggccgaaggaaccttctctatcccagtggcttggacagcataagatgcagcgggaagattatgagagatggaaattgtatgagatggatgcaggggaagcatttgtttcacagacagccagaccaaaagagattgaagcctttgtgaaggatgcatatggtatgccgtatgttccgggcagtactttaaaaggcatgttccgcacggcactgattgcagatgagatacaaaaatgtccggaaaaatatgaaagaacaggcagggagatacagtctgcttccgcagaacgcgcaagcaggaaacaatgccttgcaagagagacaaaacgtttagaacaacagatattttatactttaaaccgtgatgaaaaaaagcctgcaaatgctgttaatgataatctttccggtctgcatgtaggtgacagccagcctatcagtgtggatcagctgacattaagccagaagatcgatgttacactagacggtacagaaaaaccgctgaatgtattgcgggagacactgatccccggaacagagatttgctttgatgtatcaattgacacgacaatctgcccgtatcagatggaagatatcatagaagcactgaatattttccagaatatctgtaaccggtatttttatgcaagattccactgggaggcaaaggaaaaaaatacagtatggttaggtggaggatgtggttttctttcaaagacggttttatatccattgcttggcagtaatgcagtaaaagttgtggataatgtgtttaaaaatacacttggaaaaaattatgttgtgcataaacataccaaagacctgcagcttaaactggcaccgcatgtctgtaagtgtacaaagtatcagggaaagctgtatcatatggggatgggaagaattgaatttgaggaaatataacaattttgcgccgataggcttaaaatcaggctttgtgatcggtatgatccagtttgatattgagatttctctcatttgcgggtttgccccgcaaatgggggatgaaagccttgtgtttggagaggtgtaagggacagtattgagataagagaaccccgtggaggggacgagaaccaagaagatattcatagtatgctttttttgtttcattgagataagagaaccccgtggaggggacgagaacagtggcaacaatagccatacaagttgtattgtataattgagataagagaaccccgtggaggggacgagaacctgtggtgcaggtgttaccaataacgcagataaccattgagataagagaaccccgtggaggggacgagaacatccatcgtgtttgccatataaacaatattggtttgaattgagataagagaaccccgtggaggggacgagaacttgatccgggcagttccgctgtcagattttcgtgtattgagataagagaaccccgtggaggggacgagaacgattttccattgcatcaaaaagattttctattctaattgagataagagaaccccgtggaggggacgagaacaatctctgtaacgtgttttcatggatttatataatgtacattgagataagagaaccccgtggaggggacgagaacttatctgtttttttataataatacacaccttttatcattgagataagagaaccccgtggaggggacgagaaccatagtctttagactttaaggcttccttaaggtcattgaaatataagaaccccgtggaggggacgagaacctttagctgtttttgttatatacttacacaagtataattgaaaaaatcttcagtaaggggacaaataaaaaacaagggaggaaacacatgagttatctttatgtcagtgaacagggtgcgagtatcgggatagaagcaaaccgttttcaggtaaagtacaaggatggaatgataaaaagtattccagcagagacgttagagatgatcgaagtatttggcagtgtccagattacgacacgctgcctgacggaatgtttaaaacggggagtgaatatcctgttttattccacaagcggggcgtattatggaaggctgatctcaacttcccatgtgaatgtgcaaagacagcgtattcaggcggaaatcggacacaatgaaacatttaaactggaaatgtcaaaaagaatcattgatgcaaagattcgcaatcaggttgttgttttgcgcagatatgcgcgaggcagagatgaagatattcatagaatgatcattgagatgcagaatatgcagaaaaaactgccatatgcgaagagtgtggaacaggttatgggatatgagggaacggcagcaaaaatatattttaaagtattggggaagttaattgatgaacaatttgcttttgaaggcaggtcaagacgtcctccgatggacccgtttaattcgctgatcagtcttggttactcgattatcttaaatgaattatatggaaagattgagggaaaaggattaaatccatattttggagtgatgcataaagacagagaaaagcatcctaccttagcaagtgatctgatggaagaatggagagccgtattaattgacacaacagcgcttagtatgttaaatggacatgaattggtaaaagaagatttctatactggaatcgatcagcctggagtctttttagaaaaggatggattccggaaatatattcagaaactggagggaaaatttcgtacagagaacagatacctttcgtatattgattacagtgtcagcttccggcgtgcaatggatcttcaggttaatcagtttgtaaaggcaattgaaacggaaaatgtgaatgaatatatgccggtgatcattcggtaattggtttgataaatgtggggggaaagacaaatggaaaattatttttggaatactgaggaagaaaatagcataaagaagctgtatattctcgtgatttatgatattgttgataataagcgaagagtcaggtttgcgaagaaaatgaatggatatggttttcgggttcagaaatcggcatttgaggcgatgattacggaaaatttatatcgacgtctgttacatgatattccagagctgattgaccgtagatcggacagcgtaagagtttacaaaataagaggatacggagaggttaatctttttggggcaagtcctgaaattaaaaatgaagaagtgattattatagggtaatatgacaaaagatatattataaatacactgggcagaaattatgttgtgcataaacataccaaagacctgcagcttaaactggcaccgcatgtctgtaaatgtacaaagtatcagggaaagctgtatcatatggggatggggaggattgaatttgaggaaatataatgattttgctccgataggcttaaaatcaggctttgagaatgttatacaccagtttgatattgagatttctctcatttgcgggtttgccccgcaaatgggggataaaagccttgtgttttgggaggtgtaggggacaggattgagataagagacccccgtagaggggacgagaatttagttctccattctctgtaaactgcataaattactattgagataagagacccccgtagaggggacgagaataatcttggatgtgctttaccgcaaatatttccaacattgagataagagacccccgtagaggggacgagaatttctttcagatcctgtaaaagcctgcgcaagtaacttattgagataagagacccccgagaaggggacgagaaccagatgggtttgatttttcttgcatcttcctgaattgagataagagaccccgaggaggggacgaaaacttgaaaacctgccccggataaatcaaattagggtttactgagatataagaaccccgctaaggggacaaaattagaataaatttttactaaataaccatgcaggaaaattaaatcattattacgaaagatggagattattatgaatcagacgatattgtttacaccagtgggaggaaccgacccgatttcattaaataattatcatgatggatcaatactgcatatttgcagattctataaaccggataaagtcattttgtacatgtcaaaagagatgttggattttcaggagaaagatgacaggtatcgttattgtctggaccgtctggcaaagatgcaggatcgtcccatgatttatgagatcatagaacgccgggagcttaccaaagtacatgaatttgattatttttacgaggatttcaggaaggtgatcagctgtatatatgagacgatggatgaatcggatacattgcttttaaatgtgtcatccggtacaccggcaatgaaaagtggattgctggtattgcagacattaggggagtttcctgcaaaagtaattcaggtggcgactccggtaggaaaactgaatgagcagatacatgagggatacgatgtcgagactttatggggattggatgaggataatctggaaggtgcacaaaacagatgtaaggaaatccagtgtccgacactttcaaagataaaaaaagaggaaattataaaaaaacatatttttgtatatgattatcaggctgcgcttgatgtcacggattcattaccagcggagcagacagcgcagtatagggatttaatttatctggcggcaaggagagtgttattagattttgtgaatgttgataagacaatccagaaaacaaattttcaatgtctgccggtgcggtcttcttcccagagaaaatattttgaatatgcacttacgatcgatattcgattaaaacgtggtgagtatgtggattttatcaggtcgatcacaccgattgtggtggatttgtttgagatgatattaaaaaaacagtgtggtatcaaagtagacgattattgcgaccagtataaacgtgcaggacagtggaagagaatgtggtcagcaaaaaaattaaatggaacggaagcaggagatgtactgaatagtcattatcagaaaatgggaaaaagatttgaagcaaaagatgtgtattcagaacatctgaaaatactcacagatcatttttcgagtgatacccgcttaaaacagttgatggaagatcttagaaatgtggaaagtaatatccggaatcttgccgcgcatgagattgtatctgttacagatgagacaattaaaaacctgacaggtttttatggcagggatatcatgagtaaaatcagggagctttttggatacacggagatttccatacgaaaagagtattgggattcttatgatgaaatgaacaggaaaatccttgagcagatgtcaaatgaataaaatatacaaacaaaacacaaaaaatgtgaatatttcacaaaagcaatgtataaattattgacatgaaatatttagaaacatataatgtgattggaggtgtgggatatgttacttgaattttcatgcagtaattataaggcaattaaggagaaaatagtattttccatggttgcaggaagtgataaatcacatcaggaagaattgtatgaatttgatgattaccgggtgtcaagaatcacatctgtatatggtgcaaatggtgctggaaaaagtacattgattgatgcggtagggtatctaggctttttggtgagggaatgtgtgaaatttcaggaaggagataagattccgagaacaccacataaactttcagcagagaaaccgacagcgtttgatattcagtttgttgtggatggaatacgttatgcgtatggattttccatgaatgatgttgagtttctggatgagtatttgtatcattttccatctggaagacaggcgaagatatttgaacgtgaaggtaaaaagttttcatatggaataaagtataagaaagaactgtctcaactggagagtaagacaaaaagtaataaattatttctgactacggcagaagcgtggtgcagtttaaaagaaatcattcatcctttcaggttttttaaagaagaattgattgttcatggaattggacctgataattggtttgaatactctgcagaacagattcggacaaattctggtatgaaacaaatattagttgtgttcatgcaaaaaataggaattccaattaaggatatccaggtaaaaatagaaaacagacaattgacaacacaggatatgccgcttgaattattaaataaggtccagatgttaactggtatgggttcattgcagacaatagaagtaaagtttgtatataaagattatattttgaatatcaatgaggagtcacagggaacacagaaactttttaaattgctatgtccgtttatagatgtgctagtcaatggaaaagtgttattttatgatgaacttgaagctagtctccaccctgcacttgtagatgaattaatccacacatttaaaaactggaaaagtgaaaaaaatccacaattaattttttcctcccatgatacaagtttgttggatctggatttattccgcagagatcaaatatggtttgcagaaagaaatcccgggttgtgcacgacagagtattattctttagtggaattgaaaaatgtcagaaaggatgacaatataaaaaaaggatatatcaatggtcgatattcgacaattccgttaaagggaagcagtttgatcgaagttttgggaggtgaataaatttggaacgaaagctaggactcagttccagaaatgaaaattccagaaatatgttagtgccggatatgcacgtttcaaaacttgatgaaatgtatgaacagttttgcaaaaatgtggaaacggtaaaagaaaagtttcatattgcagaacaattagataacgttcatgaagaaaaagcagtaaaagatatttatcggtcacagattgtgtttttggaaagtgcactggattattatatgcattgtcttggaatttatgcgatggtacaaatgtataataatcactgggataaaacacggggatattccgatttaaaggtgccgattgataaggtaatggatgctgttatgcatcccgaaaatacagggtggattgacgcggtaattgtgtcttaccatgcatcaaaaacatatatgagtgcgaaagagattaaggggcagttatcattaattgttggaaaagatttttttgataaaatagcaaatgaaatgttttatgacaaggagagcagagtgaaaccagcagacaaattggcaagagcattgacagatttgtttgaacgcagaaacaagatagcacatcaggcagatagaaatcaccagacgggagatttgtatgatattaaccggcaggatgtggaaaatgcaataggtgttgttgaaacatttgttacaactgttcataagttattaacggaataagagtactgcatgacataaaaaagcaagggacaacatcccttgcttttttctcccctctgtgctacactgtcacaagctgacaagacacatgttgatcacatgaaaaacagcaaagaggagtaagaaactccggattggagagattatggaaaaagtaaaggcattttgtaaacggaaaaacattgagatatccgtcaagcgctacctgattgatgcacttggtgcgatggcacagggattatttgcatcgcttttgatcggaacgatcatcagtacacttggaacgcagcttaatattccgattcttgtgacagtcgggacttacgcgaaagcggcagtcggaccggcaatggcgatcgcaatcggatatgcactgcaggcagcgcctttagtactgttttcacttgcggcagtcggtgcggcggcaaatgaacttggcggggcaggcgggccgcttgcggtacttgtggttgcaatttttgcagcagaatttggaaaagcagtttccaaagagacaaaaatcgatattattgtcactccgtttgtgaccatttttgtcggggtcgcgctttctatctggtgggctccggcgatcggtgcggcagcgagtgcagtcggtaatgcgatcatgtgggcaaccgaactgcagccgtttttcatgggaatcattgtatcagtgatcgtaggaatcgcactgacactgccgatcagcagtgctgcgatctgtgccgcacttggacttaccggtcttgcaggaggggcagcacttgcaggatgctgtgcacagatggttggatttgcagtggcaagtttccgcgaaaataaatggggcggactgtttgcacagggaatcggtacatccatgcttcagatgggtaatatcgtgaaaaatccgcgcatctggctgccggcgacattggcgtctgcaatcaccggaccgatcgcaacgtgtctgttccatttacagatgaatggtgcagcagtttcctccggtatgggaacctgtggactggtcggacagattggtgtctataccggatggatcgcagatattgaagcgggaagcaaagctgccattacaccgatggactggatcggactgattttcgtaagctttcttctgccgggcgttttatcatggctttttagtgtgttattccgtaagatcggctggatcaaagaaggcgatatgaggctggacttataaatccataaaagtttagaaataaatccaccataatgaggaaagtatggtatactgtaaacagtagtcattacaggaataatatgcgtgaaattgcattttactccgcaaaacaaggaggatttttatggaaaagccattcaccttaagtgagggcgttgacagttggaatacgattatttttttatataattccgcattgaaggaagtacgcacaaaagttgaaatcttaaacgatgagtttcagcaggtacatcagtacaacccaatagaatatatcaagtcaaggatcaagacgcctgagagtattgtgaaaaagttaaagcgttacggatatgagtcatcgatcgataacatggtcaattatgtcaatgacattgcaggtatccgtattgtctgctcttttacttctgatatttataagcttgcagagatgattggaaaacagaatgatctgaccgttatttccatcaaggattatattaaaaatccaaaggagagtggttataaaagttatcatatgcttgtgactgttccgatatttttatcggaccgcgtgatcgataccaaggtggagatacagatccggacgatggcgatggatttctgggcaagcttagagcataagatctattacaaatttgagggaaatgcacccggctatatcagcagggatctaagagaatgttccgatattgtttctatgctggatgcaaagatgctccagctaaatgaagcaattatacaggcgaaagaagcacaggaggagcagacgggtgcagtataattatgacttcgagattatgtcgctcgtcatttttgcggttatcagcggtcatttcctgttgatcagacagtttccagcggttaagtcaaaagtatttggcagactgcttggggtgtgtcttggcgagtgtatcgcaaatattttatcatgtattggactggcaaatgcagcaatcgttccattaatctggaacgaattgtttacgtttgctttttttgcgttagagggagcggcttcttatctgatgttccgctatatggaagaggtatgcagcttttccggagtagcaggtcgaatgataaaatacatgggaaaagtcccgtttttctttttcgagatcatgcttttagcgacaccgtggatgggctttttcttttattttaaagatggcagctattatcagggaaattttgcatggtttggctatgcgtatattggatactatttttttatgaacctgcttcttatatttttggggagagcgcgtattgagacgcggatcaaggtaatcgttatcttatacagtattgtggcagttcttatggtggtgcttcagtatgagagaaaagaaatgctgcttaccagtgcggcaaatatgctgtttattctgatgatctatatggcaatgcagaatccgtctgcttatattgacagtgaaactggaaccagtgatgagcaggcatttctgatccagatgaaaaatgtaacggagcaatccgggaaaaaagtatttcttgtggtacatatcagacagatgcatcatatcgaaatgcttttaggatatgaaaacagcaggcggctgcttgccgaagtgggacattatcttaccgcactgtgtggaaagttctgtgtgtttcgcaatgcggaggatacatttaccatcctgctggatgagggaaaagaagaacacataaagggacagatcaaaaaaagatttgaacaggattttcatgtgtctggcaatttgatttctttaaacgaggtcatgatcaccctgcattatccgagagatttttgttctctggcagagtacagggcactgtatggatatttgctggaagcggcacaaaattcagggaaacaggtcttttttgaggtggatgaagccgtaaaaaaagactattaccgcagaaataaggtagagcaggcggtggatcgtgcaattacggaaaacagatttgaagtatattatcagccgatctattccctgaaagaaaaatgtgttgtatcattagaggcgctggtgcgtctgaaggatgaaaaacttggagtcattccaccggatgagtttattccgttggcggagcaaaacggaacgatcacacagatcagtgagatcgtacttgaagagtgctgtcgttttctggcaaaacatgtgcttccgaacccatcacttggaatacggacgatccatgtaaatattgctgcagcgcagtgtctgaaccggaatctgaaagaaagcatactgccagtgttagagcgttattatgtgccggcacatatgatcacgctggaactgacggagcggacagcagttgaggcaccaaagctgatgttatggcacatgcaggagtttggcaaaattggcatggggtttgcgatggatgactatggaagcggcaattcgaactgttcttatctgatccgttttccatttcgggaaattaagattgataaaaacatgacctggtcctattttgaaaatccaactgcaaaaatcgtgattgaaaatgaaataaagacgatacaaaaactcggtctcccactgatcatggagggcgtggaaaagaaagaacagagtgatgccttagaggcgcttggtgtggatatgatccagggatattattacgggaaaccgatgccggagacggagtgtctgcgctatatcagaagaatgcattctgccaaagaggaatatggaaagagttgatggaaagtttatgctaaaaatagcattttgtgatgatgatttagagatattaaaagaacttggtatcttattggacaaatataaaaaagaaagagacgaagaccttacctatacggtatttcagagtcccttagagttactggccgcgattgagaaagggttttctttcgatattttatttttggacattttaatgccgggggaaaacggaattgagactgcaaaagaaatcagacagtatgataataatatgaaaattatttttcttacctcatctccggagtttgcagtacagtcttatacggtcggggcatatttttatcagttaaagccagtctgggaggaaagttttttccagctgatggattccgtgcttgcagagtgcacaaagacacaggaaaacagtctgattctgcggagcaaagaaggaattacaagaattgaccttgaaaagttagaatattgtgaagtgataggacggacgctcttttttcatctcggaaatggaaaagtatttgagagtgttggcagtttagacgatttatttttgcagttaaagccttatggcaattttttacggccacatcggtcatttctggtaaatatggattatatacagaatatttcttaccgtgcaattaaactgataagtcttgcagaaataccaatcccgcatgggaaatgctcggagataaagaataaatatctcgagtatgcgtttaacagaaagcaggtatttttatcatgaatcttctttatgtaacaaatggtgcagcagtcgggatattcggcatggttttgtccggggctttttgtgatattcactggacgaaagaaaaacgggaatttcttgttggaagtatttttgtgctgcttgccatacagggcgtgatgtatctgttggcaggggcagcgacgatccgttatctttatcctgtgatcacacatgtcccgatgtgtattgccctttacattttaacgaaaaaacgtctgtggacagtgatttccgtgctgactgcttatctctgctgtcagcttcgcaggtgggtggcactttttataatggctgtgtttgtgaacagtgaaacggtgcaaaatgtgacggaactgattgttacactgccgttattatttcttttactgcgctttgtggcaccctcggtgcgggcaatatcaaattatcccgtgtcaatacagcttcagttcgggttgattccggcattgggctacggctttgattacctgacgagagtttatacggatttactttcagaaggtataccggcggcagtggaatttatgccgttcgtctgctgtattgcttatctggtgtttgtgcttcgtacttcagaggaggagcggaagaaaaatgaacttgagcagatgcagagctgtctgaatctccagatttcccaggcggtccgcgagattgaggctttgagggagtcgcagaaagatgccagtacctaccggcatgatttaagacatcatatgcagcatctgttatcatgtatcgagaatggaaaaattgaacaggcagaaggctacattcatgaagtatgtgtgcagattgaggcaggcagggtaaaaaattactgtgagaatgagacggtcaatcttattttttcctcttttgcaggaagggcggaaagtgctggtgccacaatgaacataaaagcggtggtgccatatattcttccggtttcggagacagatttgtgtgtgcttttatcaaatgcgttagaaaatgcactccatgcgtgtaccgcacaggagcagaagggaacgatagatattttagcgtatgagaagaacgggaggttcttttttcaggtcacgaatccatgcagaaaagaagtagtatttgaaaacggtgttccggttaccgaccggccggggcatggaatcggcgtacgcagtatttgtgcaattgttgaccggtatggcggtatgtacagctttctggtagaagataataaatttattttacgcgtttctttatagggtgcagctttttgctgcactttaaaagaaataacgaaactacagatgaaaaataaaagggtgtcgattgagtgcacattatagtcgattcagaacaagttaatccactgcagcacaaaatacggtacattaatgtcaacagagagaaatgaaaaacaaatgacaaaggagagaaagattatgaaaagaaaaattttagcaattatgttgagttcaatgctggcattctcttttaccgcctgcgggaataccgaggagactgctgatggcacagtgacaaacgcagaggcagatgtagatgtggcagatactggcactgatgtggagaacgatgcggcagagaacgatgcagcagatattgttgtggacacagaggcagcagatgcacaaagcgaagatgtggaaacagattctaccgaagacttattctgcctgcttgatgtgccgattttagagatgccggacttagcaggaacaacctggagtttctgtgggggtaacattggcggtgtgcaaatgacacaggacgattatgatgctgcattagagcagtatggcggaaaattggagatcgtgtttagcgatgatggttccactgtacagatggtacagggaggtggaacgttagacggtgtctgtgaatatcattatgaggatgaaggtgtgcgtttaacatttgacaataacggcacagatctggtatacgcctgcgtgtttgcagattttgacggactgacaatggtagcattgtccgatacttccggatacaatgcggtatattttgtacagtaaaggagtatttgaatggaaatctctgtaattgtttgtttgcttgtgattttgcttgccatatggattgtttctgtacggaaaaaattagcgatcatggatgaaaatatcaatcattccatgaatcagatcggagtgcagctttcgtcacggtttgatgcgttactttccctgcttgattttacaaaaaaatatgcaggatacgaggcacagacacttacagatgaagtaaatgaaaaacggtgtatcattatggaaacttccacaccggaggaggttttgcgccaggaaggtgtgataaacgaggtgcttttccggacacagacggttttagaagaatatccgggttcgactgatgaaaatgaatacatcaaatgtatggacgcggtagagtgttatgaaaaaatggtgcagaccagccggctgatttataatgattcggtgacaaaattaaacagagagcttcacattttcccaaccagtgtacttgcacatatgctcggatttgaaaaacgggattatctggtagaaaattagcagaaaaggagatgcaaaggatgaataagttacacagaagcaggtacataaatgtagttgtatcaatgatgatggcatttttgatgcttgctgcaatgggaacgacacaggtacatgcagcacaatatacaacgggaacgattgatcctgccgaattgaaagctggagatgtagtttacaggggggttcagttaacggtagacagacagattgtggtttgtaaaaagtgcaatatgatatggattacgacgggcacggattacggtactggagacatgaaacgctctgaggtggtggctacggaagcccataaggatcatccggataaggtggggtatagcgagtttaactggtattttaatcttgacagctccggcccattgttaaaaaatacgccatttacgatcgtagaaaatgctaacattaaatataagattatctacaatacaaacggtggcagtcagatagcagaagaaaagcagacgagcctgcctgatccgctgccggctgcgacgaaagatggatatgagtttgccggctggtatacagatgcagattttacgacgattgcgcggccgggacaggcacttactgccgacacgactctttatgcaaaatgggtagaacacaggcacacattcaagaatgagtggagcagcaatgatacgtcccattggcatgctgccacgtgtgaacacaccacagaaaaaaaagatgaagcagctcatgtttatggaacagcaggtgcggaaagatatacctgtagtgtctgcaaatatgtaagtgaaacaagaaaaaaagaagctgaggctgcagataaaaagaatacggaaagtaaaccggtaaaagtaaaaaggacagaggcaaatgatgcagcattaaattcgaaatttaatgtgaaagcgggaaagacggtcaaggtaacttggggaaaagttaaagatgcagatggttatgatgtttatatggcatactgcggaaaagataaggaaaaggttgtaaagtccgtaaaggcagcggatagtttatctgttgagatcagtaaattgaaaaagaaaggaatcaatcagaaagaaaatataaaatgtcatgttcttgcatataagatggttgatggcaaaaaagtaacagttgcgaaatcgatcacgatacatgcagcaggaaagaagaataaatcagtaacagatgcaaaaagcattaaactgaaaaagacttcttatgtattggcaaaagggaaaaagctgtcgtaaaagcttcgattgtcaagaagaataagaaacgtccgatcattaatcatatatcggaattccgatatgctacatcagacagtaaagtggcagtggtatctaaaaatggtaagatcaccgcgaaaggaaaaggatcctgttccatatatgtatatgcatcaaacggatgtgcacaaaaaataaaagttgtggtcaaataagagagacaggtataaagtgaaaatgaatgtgtaggagaaaagctgccaatgatagtgataatatcattaggcagctttttataatgaacaaaggaaaaagaaaacgtgtattttgactggattatatagtataatatattccgtgtctgagagagaaataaaccataagaggatagttaaaatgagaacaggatttgataatgaaaaatacttaaaaattcagtcggagcatatcaaagaacgcatcagccagttcggtgataagctgtatctggaatttggtggaaaattatttgatgactaccatgcgtcaagagtattgccgggatttgcaccggacagtaagctccagatgctgatgcagctttcagatgttgcagaaatcgtaattgtgatcagtgctgcagatattgagaaaaacaaggtgcgtggagaccttggcattacttatgatgtggatgttgtccgtctgattggagagtttgagaaaaaaggactctatgtcggaagtgtggtcatcacacagtttgccggacaaaatggtgcagtgcagtttcgggaaaaactcgaaaaacgtggaatcaaagtatatcagcattataagatcgaggggtatccgtcgaatattccactgatcgtcagcgagaatggttttggaaaaaatgattatattgagacgacaagaccgcttgtggttattactgcgccggggcctggaagcggaaaaatggcaacctgtctttcacagctttatcatgaaaacattcgcggaaccaaagccggctatgcgaagttcgagacattcccaatctggaatcttccgttgaagcacccggtcaaccttgcatatgaggctgcaacagcagacttaaatgatgtgaatatgattgacccgttccatctggaagcatatggaaagaccacggtaaactacaaccgtgatatagaaatatttcctgttttaaatgcaatttttgagggaatatacggtgaaaatacctattacaaatcgccgactgatatgggagtaaatatggcaggaaactgcatcatcgatgatgaagcctgctgcgtggcatctaaaatggaaattatcagacgttattacaccgcagtgaataagctggtaaaagaagaagcgaccgaaaatgaagtttacaagatcgagcttctaatgaaacaggcgaagattacaacagacgacagaaaagttaccgttgcagcaaagaaacgtgcggaggaatcaggtgttccgaccgcagcaatcgaactttctgatggaacaattattacatcaaaaacgtctgatttccttggagcatcagcggcattgcttttaaatgctttaaaatatttagctggaattgaacatgacgagaagctgatccgcccggaggcaattgagccgattcaggatctgaaagtacgtttcttaggaggaaagaatccaagacttcatacggacgaggttctgattgcgttatctcttgcagcagtgtccaatgaaaatgcgaaatgcgccattgagcagatccctgcactccgtggctgtcaggtgcatacgtcggtcatgctttccgaggtggatattaagatcttcaaaaaactgggtgtggatctgacgagtgagccggtacgcagtggattgaagttatattaaatttatatggtgtatcatgagctataaaataaagtgaaagaggaaatacatgaatctgattaatatagagaatctgacaaaggtctataccgaaagaaagttatttgatggcgcgtcattttcgctgcaggatggggagaaagtcggtatcattggcgtcaatggaaccggaaagacaacacttctacggatgatcatgggggaagaggagacagatgagggaactgttacgactgctaaccatgtggtcatacgttatctgccgcagcatccggaattcgaaccggaaaaaagcagtctggaaagtgtgctggaaggaaatgtaacggatgaaaaccgctggtctgttgaaagtgatgccaaggcaatgatgatgcggcttggcattaaagattttatgcagcctgcgggacaattatccggtggacaaagaaagcgtctggcattgatatcggtacttctttccccggcagatattcttctgttagatgagcctacgaaccatttagataatgatatggcagactggctggaggattatctgaaaaaatggagaggtgcgcttatcatggtaacacatgacaggtatttcttagacagtgtgtgtaaccggatcgtggagattgataaaggaaaaatttacagttatcaggcgaattactccgggtatctggaactaaaaacccagcgtcaggaaatggaaacagccagtgaacgaaaacgtcagtcgatcctgcgtgtggaactggaatggatacaaaggggagcaagggcacgttctacaaaacagaaagcacgcatccagcgttatgaagagctgagagatcgtgaaaatccggcgcaggattcacagatggaattaagttctatttctacaagaatgggaaaaacgaccgtggagctggaaaatatctgcaaggcttatggagacagaaaactgatcgaggatttttcttatatctttttgaagggagacagagttggatttatcggaccaaacggttgtggcaagtctactctgatgaaaattattgcaggtattattccgcaggactccggacaggtcattatcggacagactgtgaaaatgggatattatgcgcaggaaatagcctcagaaaaaaatgaggatgaaaatgaaattgatctgtcatatatgaacccggatcagagagtgatcgattatgtaaaagatacggcagaatatatccagactgtggacggagtcatatctgcatctgttttattggagcgtttcctatttccaccggaaaaacagtacagtccgattggaaaactgtcaggcggggaaaagaaaagattaaatctgctccgggtattggcaacatccccgaactttatattgctggatgagcctacaaacaaccttgatatagctacgctgacgattttagaggactatctggaccgttatgagggcatcgttgttacggtatcgcatgaccgttatttcctcgaccggacaatgaaacgtatctttgcctttgagggagacggaaaactgaaacaatatgaaggcggctatacagattatgtaaaccgacttgcggcagagggcaggacaccgggtggaaacattgcggcgcggtctgctggtgccgatatatcgggtaattcacaaaaccagaaatccgaagaaagtgtgatcgaaaaaaatgattcgactgcaacctggaagcaaaaaaagaaactgaaattcagctataaagagcagaaagaatacgagacgatcgaggatgatattgcagcactcgaactaaagttagaagatttagataacgagatggcagcgaatgccaccaatgcagcaaagctgcgggagctggttgaggagaaagaaaacgcagagaaaatgttagaagaaaagatggacaggtgggagtatttagaagagctggcggcaaagatcgcagggcagcagagctagtgtactgaatcattgatacagtacactggaaagcctgcctgtcagtccacgttcaggacaaatgtattcttgccgttctcttttgcctgatacattgccagatctgccttgcggattagctgtgtatagtcaagcgtatcgccctgggacatgacaatgccgatactgcacggcaccggcagcacctcgccggtctgttcgtttacatgctgcgtgcgcagaatctcaagaattttgtcggcattatgccggatgcgttccggttctaactcaccggcatagcaaaatgcaaactcgtcccctccgatcctgccgactgcaccgtgtatgttttctttaagtgtctgcgctacgaactggatgacagcatcgccctcctgatgaccgtaattggtattataatccctgaaatcatcgatatcgacaaagccgaatgtgatctgttcatggctttcaaccgccctttgcaccatcgaaagcatctctttttcaatcgcttttttatttttgataccggtcagagggtcgttctctgccatctgtaaaagtttctgctgacgctctttttctttccggtctgcctgttccacatagtctaacagctcgttgatacccgcagccagttcacctgtctcatgtttttcctgaatgtggacacgcagggaataatcctcactttccctgatttgcgcaaatacctgcagaatatgggtaatcggtgcgaaaattttctttgtcatgaaatactgtgtacagaatacgccgataatgagtgcagaaagaccgagcgcgatcagcacaccgtaggttctgccggtctgcttctgtgcactcagattttcagtcacacggatgccccagccggtattttccacgtcggaataatatgtaatataatcctgtctgtgatagcggtagcgcacataaccggacggatttttctcatggtcgatcgcatcccattttttctgaaaatcattgcggtcggaacttttagagacaaatgtctttaagcttctcttgttttttgtgtcacctgccgtgatgatcgccccattgccgtcgagaagatagaaagttccatctgcaagagtgtccatattcagccgcaggtcgtcaaaatatgccgtatccagctcctccatcacatagccgatcagttcattattataatagacgccggtataggcgggcacgacatttttcctgccgtcatctgttatacgctcatacacgtcaccgataataaattcgccggtctgatatttaggatcgacatctttcattgcactgacagtgcccggttcgtactcttcacttgaactgaccacatgaaaattccggtttaccacagagatgctcgctacaaagatactgtattttttgcgttccttcagcagattgtctacatagtttcgtgccagagggctttcattttcccttagactgtaaaggatcgcgttctgcgtcagctgataactcgcgatcatgtccatctcgttattgcggtcctgcgtaaagtttttgatattcatcacctgattttcgctgatcgcccgcacattctgctccgtcagctcatcaatcttgcggttcgtttcataaatggaaaatattccgaagataccaagcggtatcagggtaaaaagtaaaagtaaccctaaaatactatgttttaatttcatgctcgcagcttcctccatctgttatctattttatagctaaactgctgtttccgtcaactgttgccccagtgttgtacacaacccctgaaaaatatcgaaaggatttttttccccgcgtggataagatttcgatatgattgaaaacggtcataaaatcaatcgtaaaaaaatacgattgtttttatgattgattttgcatataatcaatacaatgaaattggaaagaaaacagttagtatgcaaaggcaggaaggacactcacaaatgaaagacaaaagcgaaacttcaacaatagatttgattatactttttttccttctgttcattatttcaaatattttatttgctgttgcctgtatgctgctcagtgatgacgcagagtcgaatttgaagctgataaaagattttgcgatcagcacgggaagtctggtcggaataaacatagtcggattgatactgattgaatgttttgaaagaattgaaaaatatatttttcggcgaaaaaaccaaaaggaatgtttcggggaaggtaattttcaggtattgcggtgtagcagcagatactacatgctcccgattgcagttactgcgctggatatgatgtttgtattatcttttttgcatgagagaaacaaagatgcacaggtgatgatagaattttttcaaggcagagatggaatttttccactgttttgtatgggattttttaacatctatggcgtttatgtgctggcgcattactgctgttataaagtgtattgtacaggatatttgttagaggtaatccattttttgaggaaaaaaagcataccgtggagtgatataaaaagcatagaatttttctatctggatcaatacaagaaacagaggattgtgataaatcttgagaagaaaaagattgtttttcgcgcagaggtgttaaacgatggctgggatccttttgtgaactgggtacaggatatggcaatgagatatcatattttgtttaacggtaaaatcctgactgtttgacttgcaaataagataaaaatccaaaactacacaccagatacaatgcattacggtatgctcaaaagaaaagggatatagagcgtaaaacggacagcacaccaggttgactttgcctgcgggggaaggtaaaatacagcttaagatagtataaacccggggagaaaactgcaatgctaaatataaccattgacaaggtcaggcacattgaagacaaggatgccaatgtacgcgacacgcttgtcgaattacagcacgcacttgataaatctgaacaggaaagacatttttatgacgctctgtgcattgactacactgcggcatacttatgcgacctgatggcagataccatgactgtcatcaagaaaaaatcattctcccactgtgctgccgaagaactccagtctggcagcatacaatgctattctcaatggatacggcattcttataatacttttgtcgtgaaagagtcggccccgggctttatggaaatgtttgacaacaggaatctgatggcatatctggatgatcatgagagctttgtataccggcacagaacactgccgaaccgtgcaggaatggaatactttgaagcgcgggcagtgcgtctttattcagatgatgacagctacaagatcattcttggctaccgtccgatcgatgacattgtcgaagaggaaagggaaagccgtcaaaaattagagcaggcgttaaagagagccgaggaagcaagccatgcaaaatcagccttttggtttaatatgtctcatgacatccgcacgccgatgaacgccatcattggttatactgatcttttagaaatatatggggatgacgtggaaaaacgggaggactatcttggcaagatcaaaagttccagtgaatatctgctatcccttctcaatgatgttttagaaatggcgcgtattgaaagcggaaaatatatcatggacgaaacggtaacggatatcagggagtttgaccggtctatctgcgatgtatttgagaatcaattagagcagaaggggatccgttctgtttttctgtaagttcttttgcgatgctggcatcaggcatggctgctttgccgttttgtccggtgctgcagtgcgttaaaccatgcctgcggcagggaaaaaccgaagatgatgccaagtacgatcgcaccggcaactttgatcgtctccattccgtaacgtgaaaattcactcatgtcattcataataaaataataggaagtataataaataccagcccccggcaccagtgggaaaatacctgcgatcaggtagatggtcacaggatttttccgcagggctgcaaccacccttgaaaagactgtgagggcgagcgttgcaatcatgtttgcaatgacggttccggtgtcaaactgcaggcagatcagatagacgatccatccgatcgcaccggtaagtccgcagaagagaagttctgattttggtgcacaaaacagcacggcaaaagaaagcgttgcgatcatactgacaataaactgaataaacatagtattacaaaatacctcctactataagattatagatcgtcatgacggttccgacacctgccgcaatacaaaaagcggtgagaaccgcatcgatcatgtggatcgcgccggagagataatcgccgttaaagaaatcgcggattgaagtcgttaatgcgatccccggcactaacggcatgatcgcaccgatgatgatcttgtcatacaaaaccggcagtccaatggaaaaagtgatcagactgacgagtgtcacaagtgcgctgccgaaaatgttggtgataaattttgaagttttccgctgtgaaaacttttttaacatcatatttaaaattgcgccggcgataaatgcaatcacgccgtctaacggagttccgccaaacagaaatgaaaaactgccgcttccaagaccgcagaaaaagacttctgtccatttgctgcaggtggggattgctttgcattcatccagacgtgtccacgcatcttttagggaacattcgtgggaacagatttccctcgaaagctggtttaaggctgcgatacgcccaagatgtgtctgaccgagcgggacatgacggatcatgctgcacgcgtcatctttattttcatttgcactcgcaaaaattccatttgagagtacataaacatcatattcttcaatttcatatgcctctaagatatgcattacggtatcttctacacggtatacttctgcgccatttcgaagaagtgcatcaccggtttccaccgctaaagataaaatttcctttgtgactgccatgttgcagttcctttctatcagtgaaattgatcattatagttgttcaactgttatgttaaaatcccgttcctgccagacaggagtttttattatgaacactcatgaaaaaataacatgtttttggataaaaagcaatctgtcatgtgtaaaaaattatatactttccaataaaaagtaagatgccatatgcaataatttcctgtaaaagtaattttacatattctaatgcttctattttgtttatacataatatccccaaaaaaagagataataatttgcaaagtcagaaatcaatggaggcttagtgtgaaaaataagctcgatagcttatttttcgcacggctatttgtttctgagcaaaaacaaatagcttctatgacaaggcataaaaaaacatgcctacgagaatttgagattctcgttgcctcttcgcaacaagttgctcagaaatgaggtttactatgaattgtagaaaatacagagcagttttacttggagtgatagttatgatactggtggtcggggtttgtttctacacaaaatatcggaaagaaaatgagataccgacggatggaatgttggtatatgacaattcggaggatgaggatgtgaataagatatgggcgtaaataacgaaacactttatttgaaaatcgagcagaacacgatcgtttatgaccggcatgtcgtgctgaacgatattgcaaagatggagtgcacgaacgaagcggttctgcgtcagttaaaacagaaaaagatatacagttttacgaatcagaaagatgagaaaaaagagaaaaaccagatgcaggttttttctgtgttaaagatcattgagcagattcatgaagattatccgtcgctgacgatctccaatgagggcgagagtgattttatcatagaatatattccgaacccggaaaagccaaaggtaatgaatacaatcaaaactgtgctgctatgcattatcattttttttggctccgcatttacgatcatggcatttaacaatgatatttccgtgacggatgtgtttgacaaattatacggacaggtgacggggacaaaggcggacggtgtgaatgagcttgaagtgtgctactgcatcggacttggacttggcatcattttatttttcaatcatgtcggaagaaagaagatcacgcccgatccaacgccgatccagatcgagatgcggaaatacgaaaaagatgtggataccacatttattgaaaatgcaggcagaggaggtcacagcatagatgtttcttaatcatattctgctcggatttttaggaattgcgtttggcggtgcggtcgctgcgggaacgttcgcgtttgtgatcgtcatcggtgtcgttccccgtatgatcggaaaatgcaaccgtgcggcgaatacactctgctttgagcaggcgatcatccttggtgggatacttggaaatatcgtctccgtgtttttgcagatgcatattccgcttggacaggtatcaggacatatctttctcggattgtacgggctctcggcgggaatgtttgtcggctgcatcgcggtggctctcgcagagatattaaacacattcccaatcctgtttcgcagggcaaaactgaaagttggtctccagtgggtcatgtggacgatggcggtcggcaagacgtgcggggcgctttattattttgtgaaaaaaatcggggaagggttgtcgtaggagaggtttgacgtgtgaaaaatttcagattaaaatgatagaggtttggaacaattttttgttccggatttttcataatgaatacaaacagggggaatgagaaatggtcacatccatcgcacgtcagagtgttatcataaaatgcaacatgcagaaatcagtcctgaccggcaactacgaattttattatgcggcagggcttattgcaaaattattcggggttgagatttcagatgacatcaaaccgatcgaactggggaaacttttacatcaggaaatcgaaaagacagagccgaaggatgaacaggaaaagtacctgttttcgatgctaaaggactataagccgaccgatgagtatgatgaacagatgaaggagctgctcctgtggggaaaaggcgagcagtatctgtggacggtgacgattttgtgaatcaactgttcagggtaatttggattggagtcatagggagcatctgcccattctaagagttcttttgaaaagctgcgaataaatatagaaaagatctgacatactattccaataagaggaaaatatacgggaggaaaaaccatggcacaaccaaccaccaaacaaagcagttcagccaaaacatcagatgagcaaaagcagaaaaatttatccaaagtgtcatacggcgcagacaaaaaagtacgagaccaggcatacaatgaatatgtggagtccatcaccccaaaacacaaccttgcagcaaatatggcaaaggcatttgtgatgggagggattatctgctgcatcgggcagttcattttaaatatctgtaaaagccttggacttgataaagagatgtcgggtagctggtgcagtatcctgttgatcttattatctgtgatcttaacagggcttaatctgtatccgtcacttgcaaactggggaggtgccggtgcgctcgtgccgatcaccggatttgccaacggtgttgcggcaccggcgatcgagtttcagaaagagggacaggtctttggaatcggttgtaaaatatttacgatcgcgggaccggtcattttgtatggtattttttcgagctgggtattgggactgatctactgggcggcaaaaatgtttggattttgttgacaataagctgattgctatgctttactaaaagagtaaggtttcttttcgatatattagaagtcagtgaaaccacagaaatagtctcgcagagtgaagacactgtgacagagcaagcggtgacagaagaaaccgcagacagaacagaaagtacagaaagcacagatgcgacagagctagacgaaacaacggaaatatcagatacagcagaaactgaaatatcggaagaaacagaaactgaaaaagagtctggcgcaacacagatcttagcaggaacctacgatgctgttatcggcggaacatattcaggtgtgtgtgaaaatcagggggattattacctgtactatgttacactgccggaagcaggaaagctaacgattgcgatgacggcacagatggagaagtgtgaggtatccgtatattctacggatgaggaagaactttattcacatacggaagattgtaatgaaaatacgaaaagagttgtggcatcctatgaagtgtatctgactgccggtacatactatatcaaggtaatggaagctacagcggtgttaaatctgtaacaataaaaaaataagcatgtaataaagcagcgataaggagacgtggatataaagtctgcgtctcttttctgcataaactatggctgcttaaaacgtgatatttctgagactgaaacaccggtgaactttgaggtgaattattttttcaccggttttgtaatctttagcccaaaatgctggataacgaggaaaatcgaaaagatttggatgagataggatctatcatcacaaataagatcaatcagcagccgtcttgttcacaagatggattcccagatacagttaaaaggtacactgggaagggaagcagattttattttacattgcagttaaaaccggtggaaagtgatctgctgcatgagatgacaccggatctgtccatggattttaccggaaaaagagtctttgtggtggaggataatgcattgaatatggaaattgcatgtatgcttttagatacatttggcattgaagttaaggaggtgtataatggaaaagaagcagtggaagatgtgcgtactacaccgccaggatattatgatgcaggaaatggatggactggaggtaacgcgaatgatcagacagcctgacagggagggctgcaaaacacttccggtcaatgtcagtctgttaaaggagacacttgcgtcaatattgggttgatatttcagagtattggttaaaataatttagagaaacagggtagtgaaaaggagaaacagaatgcagacaggaaaaggtatttcaataccatccatcttaaaagttggaaaaggtgctttaactaaaataggcagttatttaaagaatgaaggaatcgaacaggccgttatcttttttggaaatggtctgatcgatatgtttggaacggatgtgatgaattcattaaagcaggaggatatcaaagtcttagaatacagtgaattggataccgtggatatcgacgaaatcattacactggcgtttgcaatgccaaataagacacaggcggtcatttccatcggtggtggaaaggtcattgatgcgggaaaatatgcggcatttttacgcaatcttccatttatcagtgtgccgacttccagttcgagtgatggattttccagtgcgagtgcatcccttcttgtccacggaaagcgcacttcggttccggcacggcttgcctacggcattattgtggacacacaggtcataagaactgcaccggagaagtttatctattccgggatcggcgatatgatctcaaagatcacagcactttatgactggatctatgaggaaaaatgtggttatagtgaagtgaatgactttgctgtcatgatcgcgaaaaaggcggtcaacagttttgtgcggacaccgtatgagagcatcaaagatgaactttttttaaaggagctggtggattcccttgccatgagcgggatcgccaatgagatcgcaggaagcagtgcaccgacaagcggaagtgagcatctgatctcacacgcattggataaaatattagaaattccgcagttacatgggattcaggtcggaatcgcaacttatatcatgagtaaagtgcaggatcaccgttatgtgcgtgtggagacggttctgcgggaaacaggattttttgattatgccgcgacgttaaagatgaagcgtgatgattttatcaaggcaatcgatatggcaccatccatcaagccgttccgccacacttatctgcatgaggaaaactaccgtgaagcggcaaaaaaactggtacttgaagatgaagttttaagtaagattctcgtataaaaacagaaataccggagaaaactaaataaaaatacaaatgagaaaagtaaatgttcctgtgatggggcatttactttttttatttatgacaatagaatgttcgcggagcgtgcattctattgttggaaacaaggtgaaaaacagggaggaaaatcctctgctcgctaatgagctcgcattttcctccggaaaacagggaggattgtatgattaaagaagatggattaccggtaggacttgggtttggattagcgatgaatgagaaagcgttaggacagttttccatgatgacggaagacgaaaagaggcaggtcgttgatgcggcgagaggtgcacagacaaaggagcagatggcgcagatcgtaaaagacattgcggatatggaatttttttagaattggagattatgatgggaaataacatggatttaaactatgagatgttctgctaccagtgtgagcagacggcaaacggaaagggatgcaccaaactcggtgtctgcggaaagacgccggagatcgctaatctgcaggatcttttgatctttcaggtaaaggggatcagctgctacgggaaagtgctgatggaaaacggtgcacatatggataagacagtggtcagttttattgaaaacgtgctgtttacaacattaacgaacgtgaattttgatgtggatgcacatttagaactgctacgggaatcacagcggatcaaagagcaggtcagggagatggcgggaaggagcagcaatccgacggcacatgctgcctacgatctgcctgagagcaagagcgatatgctgcgcgatgcaccgcttgcgggaatcatgtacgacaatacattagatccggatatccgttccctgcgccagacaatcatttatggattaaaaggcatcagcgcgtacggacatcaggcaagagaacttggttattacagtgacgaagtggatgatttttatcttttggggcttgaggcgacaacagatgacagtctgacggtggaggagctgatccgcatgacgatgcgcaccggtgagatggcgcttgcggttatgaaaaaacttgatgaggcaaatacgacgatctatggaaatccatatccgcacaaggtggatgtgacaatcaaaaaaggtccgtttatcattgtttccgggcacgacttaaaagaccttgagatgctgctggagcagacaaaggatatgggcatcaatatttacacccacggtgagatgttgccgtgccacggttatgaggggttaaaaaaatatccgcatctgatcggaaattttggcggtgcatggcaggagcagcagaagcagtttgacaaccttccgggctgtatcctgatgacgacaaactgtctgatgcgcccgcgggaaagttacaaagaccgcatttacagcacgaacgtggtcggctgggaaggtgtgaagcatatcggaaaaaatgaaaaaggggaaaaagatttcagtgagattataaagcaggcattggagcttggcggatttagggaagatcaggagaagaaagagattttagtcggctttgggcatgccgcagctttaagtcaggcagataagatcgtggaggcggtaaaaggcggacagatccggcactttttcctgatcggcggctgtgacggagccagaccgggaagaaattattacacggaatttgctcagatggtgccgaaagactgtgtggtcttaacactcgcctgtggaaaataccggtttaataagttagactttggggaggtggcaggactgccaagacttttagatgtcggacagtgcaatgatgtatattcggcggtcaggatcgccacagcgcttgcggatgcgtttgaaactgatgtcaacggacttccgctttccatgatcgtttcgtggtatgaacagaaagcggtggcagatctcttggcacttttaagtctcggtgtccacaatatctatcttggaccgacactgcctgcatttttaagtccgaatgtattacagtatctgaccgatacgtttcatttgagacagatcagtaatgctgaggatgatattaagacctgtctcaaacaagatattgcgtaaaataaaagatgatctgcatgatgaatgaatagaatgtccgcggaaattttggtgtctgtgtaaagaaatcacgactcgaaaaatccaagctgctctaacgcataagcgataccatcctcgcttgcgcgttttgttacaaaagatacctgatcaaacagggaagccggggaagcatttcccatggcgacgctgtttggtacataagagagcatcggaagatcgttgttgctgtcgccgatcgcataggcggcgtcaagatccagatgataatagtcaagcacatactggatgccggtcgctttgctgtaaccgattggaacaaattcgcggaaggtaccgccgcggtcgatgcaggtaaaataaggatcgctgactttccggaattcttctaactggtcaggagtctgataccagaccacaaatttatcgcagaaaaaattcggattttccaaattctccggcatatcatagccgcggtttaaaaatgctttatactggtgtatggcatccgggtgtgtgagggatctgcttttatcaaaggcaacttcttttctggattcgaaaagaatatccacattggttatgcgtgccgcctctaacagctgcatggtaatgctgtgtgtctgtgcaacgtgcagtgcctctgtgccggaacagaaaatatttgtgccgcatccgcagacatatccgtcaaaaccgatccgtctgaaacgtggttctacgttctgaaagcagcggccggtattaataaacatcagatgaccaaaggtgcgcgcatgtctaatggcatttatggcactcttcggcagggaaccgtcgatctccgaggttaaggttccgtcaatatcaaaaaaagcaatttttttcataggctgatctccgtaaaataatgatgataaatatttttaaccgaaagaattgtacggtatttttttcgaattgtcaaaatgaaatgggaaatggtataatgatcaggaaaatactgtgaaaacagcgtgggaatggaggattaccatgaaatatcatacgataaatgaactggatcatttttgttttaaggaggcatacattgcgcagatctgcgcggtaaacgggatgtttgaaatcgtatttgataatgtgacgattctgccggagaattcctgcaaccgcgatatccgggagatgcgtgcaaatgaactggttttaaagatcagtgaaccgaaaattgaagcactggtggaggaaggctataaagtctatgatgcgaacggcaatttaaaacagaaaaatgaggatattacgatcgcgccggaagcgtatgcagacaaattcaaggaattagagggctgtgaagtgtattccattgagcaggaaaacggaaattatgttatttccatcgatacggaggatcatacctttttgcttcgcgtcagcggttccggggatacacaagagtgggatcgtttcttgaacaaataaccggagataaaaggagcatacgaatgaaaatattagtgacaggctttgaaccgtttggcggagcagtgatcaatcctgcctacgaggcagtcaaacttcttccggatgtgatagtgggggcagaagtgatcaaaattgaaatcccgaccgtgtttggaagggatgaggaagtggtcagggctgcggtggagaaacatcatccggatgcagttttatgtgtcggacaggctggtggaagatccgggatcacagtggaaaaagtcgcaatcaatctgatggaagcgcgtatcccggacaatgagggaaagcagccgctcgatacaccaatccgggaagacggagagaatgcatattttgcgtcgcttccagtcaagagcatggtacagtatatgaaagaggcaaagatcccggcgcgcgtttcctatacagccggaacttttgtctgcaacgatatcatgtaccgtgtcctctacatgatcgataaggaatatccacatatgaggggcggatttgtccatgtcccatacttaccggagcagacgcttgatctgccggagggaacaccgagcatgccggcggagatgatcgcaaaggcattagcgtgcggcatccgggcgatcgttgagaacgaggcagatgtgaagacgatcagtggggagacgcactgacctggtgcacatgacaacgtgagtgtgtgacaaccggcaattataaaaaagaatatcatgaaaaacgaaaaatgccggagtggtgcaaaaagatgtgtgccactccggttttttatatgacacacttatttaacgctttcttcacataaccatcacattgcaatcagctgttctttaggttgcgatgttatttttgtattgtcaaaacggagcgcatgagtatggaaagtgaggaaggcaatgagaaaaccaggaaaaagaatggcaagtgtgatcgccagcatcgcagcagtctgtgtgatgactggcggaatcggatatcaggctgcagtatccggggcgcagacagacagcacggaaagtagtgtaaaagatcagaatacagaccagcaggagagtacagacggctctttttcggaagaaggtaccacgcagatcggtacggtcagccagatgccggaatttacggtaaatgcagtcacaatgaccgtggaagaagtctatgcttcatccggggataccgtgagcaaaggggatgccctgtttaaactgacggatgagagcatggaagcggcaaaatcatattacgaagatgccatcagtgatgccgagaatacattaaaaacagccgaggcgaatcttgcaagcggaaaactttctgcggagagcacaaagcaggacgccgatctgacagctcagaccgcagcggacagttatcaggcacaggtagatgcgctagatgccgcagtggaagaaaaaaaagaagcctatgatgaggcggtagagcagatttcggaatatcagatgaagatcgataacaatgattactatgtggagtgtgcgattgatgaaaaaaaggctgcagttgatgcagcgacaacagcattagcgcaggcacaggatacgctgacacaggcacagcagtctgcagatgctgtacagagtacactcgaacaggcacagaaggaatttgactccgcggtcgaaacttacaataaaaatgtggaagaaaccaacactaaaattacggaactgacggatagtctggatgatttaaaatctgactatgaacaggcagagcgtgatgcgacaatgcagaaagcagaactgcaaaatgaatatgacactgcagtggtggaaggaaaatatgcgggaagtacctatgaatcgaccgtctcggaactggagagtgcagtggagtccgcgcaggatacacttgatacattaaaagaggaacagacagcacttcttgcattagaaaatggtgttgttacggcggatgaagatggaacgatcgcggcagtgccttatgaggcagaagatacgctgcagtcaggtactgcgtttgcgctgtattgtgatacacagacgatcatgatttccgtggaagtgccacaggagaatatcgcacaggttggcgtcggcgatgaggtatctgtcatgatagcaggaaaccgggatggagcagtgacaggaactgtctcatcgatcgcatcttcggcaacgaccggaggcagtgtttcgaatgttacttatgcagtgatcatttcaattgataattcggatggaagacttggttctggttcttccgcaaccgttacatttcagggagagcaggaggaaaaaacagaatgaaaaagaaaaaagtgacagtagttctttcattgggcgcagcagcacttcttttgatcggagggatcagcgtatatgcacatcagacttcggacagcggcgaatcagaaacggtttataaagaaacgacagcagaatatggaacgcttaccgtcgggattacagagagtggaagtgtgacaatcggaagcatttcacaggatatggatgaagatatcagtacgtcttcaaattctggcagcagccagacaagtggaacccagacaacaggaacatccaccaataattcatcggtggtactggaggtagaggaagtgtatgtttcagtcggacagcaggtaaaagcgggcgatgcactgttaaagctgacagatgagagcattgaaaaatacaggaaaaaattaaaggaagctgtgacggaggcttcggcagattataactctgcagcactcagttcggcaaaagaaaaggtaagtgcgaactattcttataacttaagtgtggcggagggaagtgttgcacaggaagaatatgaggcaaccatcagtgaactgcaggatgcggtggatgaggcccaggaggcagtggatgagtcacaggcacttcttacctattatcaggaaatgatcgacagtggaatggatttaagtgagtcacttgcagatgagcaggaaaattatgacaaactgtacaataaattaaaagcggcaaagagtgcatacactacaaaatccgtggaggcagagaaaaaatacaaagaggcaatgttatcctacgaaaatgcagacagccagtattccgcagatgtgacaggcgtggatgtatcagtggatacggcgcaggacacgttgacagatgccaaagaggctttatctgaatttgagatatttgtcggagatggcacaatctattcggattatgacggcatgatcatgtcggtcggatatgaggcaggagatgatctatccacaagtacgagcatagtgacatttgcggatacagatgcagtgacgatgacggtatccgtttccgaggaggatatctctgagatcgcaatcggggacgaggtcatgatcgaactgaatgcctacgaggatcagacgttttccggagaagttgaaagtattgatacttccgtatcgagtggttcttccacagtctcttataatgtgacggtaaaaataaatggtgacgtggacggcatttacacggatatgacaggaaatgtgacattcattgaaaaacaggtggcagacgttgtctatgtttctaataaagcgatcatcaacgagggaacggcatcttatgtgaaagtcaaagacagtgatggaaccattgagaaaaaagaggtgaccaccggattttccgatggcgtcaatgtggagatcacggagggactttccgagggagagacggttctgatagaaagtcaggtgacgggcgaatgaaaccatcggaattattaagacttgtctggatcaatattacccagaataaatttaaaacaatcatgacgtcgatcggtatcattgtcggcgcggcaacgatcgtgatggtgattgccatcggaaaaggcggtcaggaggatgtggcagaccagtttaaaaacttaaatgcaggtgcaatcgatatttcctatgacggcggtgataaaaaccgtggtggaaatcaaagttccgatgactcatcagactcaggaatgatgatgatgccttccggcagcggtgcaccatccggcagcagttcatcgggagggtcaggggcttccggtggaccttcgggaggatttacgggcggtggcgactcttccggcggtggaccgtcgggtggccccggaggtggaaatggtggtgacggaggcggcatgccgggtgacatgggtggcttctttggcggcggcagtgatatggaagaccgcatgaaccaggaaaatatcacgttagatgaagatgacgtggacgatattgaaacttttgtctccgggatctcagcggcaacgatctcctatatgacaaggtctaccgtggatggcggtgatctcgatgaggcacagacctactcgatcgccggagtcaaggacagctatgcagctatcagtaatctcagtcttgcagtcggagattttatcacagaatccgatgatgagaataaagaaaaagtctgcgtgctaggcgcttctattgcggaagagatctttggaagtgcaatcgatgcatatggcagtgtgatctatatcgatgaccgatcttatgtggtaaacggggtgctttcttctatgggtacggtggcttccggtatcagcccggatgattccgttttcattccgtatgcgaccggggtgaaatatttagtgggaacgaatgtaagtccgactatcaccgtgatcgcggaggatgtaagcaatgtgtccggtgtcacggaggagatcacggaagtgcttgcaacttcctatccgaatgcagaatttacctttgaggatgcgggaagcaagatggaagctgcatcggcgtccaatgagatattgacgatgcttctgatggctatggcagccattgtatttgtggtcggtggtatcggcatcatgaacgtattgtttgtatctgtcaaagagcgcaccaatgagatcggtattttaaaggcaatcggctgctcccagaggaatattttgtttgaatttttagcggaggcggctgcaatcagtctgatcggcggcgtgcttggcattgtggcaagcctgctcgtcactccggtggcacagtatcttggtgtgcgtgttgaactgacaccggcagcattcctgattgcactgctgtttgcactcatcacgggaacactgtttggattctatccggcgtataaggcgtcgaaactggtgccggtggaggcgctgggggcagagtaaaagagggaaaggtttaaggcggttgatgaagaagaaagtaacgattgtggttgtaattgtattagtgattgtacttattgcggcatgtgtgatgtggcggataggtggagttgagacggaaagtgcgctgggggatcatcagaagtatgtctatgcgtatgtttcgtcgattgaggggaatgaagttacttatatggaagtggatgagtcggtggcgaaggcggcggaagaacgggcgaaggagaaggcaaaggcggaagatggtgccggttcggacagtacaggtcagggtgataaaagtgatggcggcacaggttcagcaggtcagagtgataagaatgatggcggcacaggttctgcaggtcaaagtgataagagcggcggcataggttcagatgaagataaatccggtatgggaacaccaccggatatggatggatcatccggtggagatcagacgcctccggatatgagtggtgcatcaactgatatagaaagtacagagcagtccggtcagaatcaggcaccgtcagatatgggaagtacatcgaccgatacagaaagtacagagcagtccggtcaaatgcagatgccgcccgacatggacagcaccgagatgccgcagggcgcaccgggcggcatgtccgatatgacaggcgagacagtcacaactatgatacctgttggcgtaaccgtacatacaacatctgacactacgaccaccttctcacgccttgcctcaggtgatctgctaaaaatattggtagaaacagatagtgacggaaatgaaataatcgaagaaatctggatgttacagtaacgtaacggcagcatggctgattgtaaaactcatcaaaaactgaaaataattgtgaaactggcactggtttataagaaggtgctggggagccgtcggtacttagcgcatgtattttatgcgcttagtatccgctacgagcgacacgcagcgagagcgtgccttcgctaaaccagtgccagtttcacaatattcaaaaaggaaaaactgagttttaaaatcagccatgcgagccacacacagaaaggagcacacatggacgcagcacaaatcctaaaaccatttgcaaatgaacatataccggcagacaccgaaaaaactgccacagcagaacacacatccgagatcatcaccatgcaaaatgtcaacaaatcctacaagatgggatctggttccctgcatgtattaaaagacatttccctgaccgtcgaacagggagaataccttgccatcttagggccatccggttccggcaaaagtaccctgatgaatatcatcggctgcatggatgtcttagacgagggaacctataaccttgacggtgtggagatcgaaaaggcaaaggaaaaagaactgactaatatccgcaaccagaagatcggattcattttccagaaatatcatctgattccgacctacaatgtacttcagaatatcgtcatgccgcttttgatgcgtggaatgaccttgaaggatgcaagagatgccagcatggataccattgcaatgttagggcttgcagagcgtatcgatcacaaaccgaatgcgctttccggcggtcagcagcagcgtgttgcaatcgcgcgtgccttggtcggacagccggcgatcctcttagcagatgagccgaccggagccttagaccgtaacagcggaaaagaagtgctgaaactatttcagtgtctgagtgatatgggaaataccatcgtcatgatcacgcatgatttaagcgttgccgaacatgcgaagagagtggttcgtatcgtggatggggaactctatgaaaattagaggtggttttcatctgtcctgtgtggtatgttaatataaaaggcatttggtttacaataaaaacaaggagagccgcacatgacaaacgaagagatctgcgtatggctaaaggcagaagcagaaccaaaatttcagaagtttacatccggtctgattcccggaacagatccgatcataggtgtgcgtatcccaaagctgcgcactcttgcaaaaaagattgcaaaagaggactggcgcgggtatttagaacacgctgcctgcgatacttatgaggagatcatgctgcagggactcgtactcggatatgcaaaaggagagatcgatgagcttttggaatatgtgcgggcatttatcccgaagatccatgactggtcggtcaatgactgcttttgtgcaacttttaaaattgcgcagaaacaccgcgaaaaagtctggaattttctgatgccgtatgcgaaatcggatcaggaatttgagcagcgtgtcgttgcagttatgctgatggatcattttctgacagaagaatatattgcgcgcgtgctgtctgtgtgggacaaactcgaccatccgggatattacaggaaaatgggagttgcgtggggcgttgcaactgcatatgcaaagtacccaaaggaaacacatgcatttttactggagaatcatttggatgacgaaacatacaataaggcgatccagaaaatgatcgaatcttaccggatatcggcggaggataaagagatattgcgcggaatgaaaaggaaactgcaaaaataagtgatattgtgcgaaatgaaaaggaaattgtaaaaataaaaggggagcagtagcatgagtgttgatacacaaaaaatcatagagatcgtaaaacaggtcaaaccgttatttttagaccgtgagggctcatcacagatcaaggtaaagggtgttgcggattttgtgacacagatcgattttaaagtgcaggagcaggtaaaaaccgcactctatgaactgtacccggaaattcagtttatgggggaggaaaaggacaacagcgatattgactttgacggtgatgtctggatcttagatccggtggatgggacgaccaacctgatccatgatttccgaaacagtacactttcactggcacttgcaagaaagggtgtactaacgcttggaatcatatatcatccgtattctgatgaaatatttgtggcagaacggggaaagggagcattgttaaatggcagtccaatctccgtcagcaaaaggcagaatttttccgagtgtctgatctccataggaacaagtccatattaccgcgaacttgcaaaagaaaattttagaatttttgaaaaggtatttacggattgtgcggatatccgaagacttggttccgcagcattagaacttgcctatgtggcggcaggaagaatcgatgcatacttcgaacgcagtttaaaaccctgggattatgcagccggaatgctccttgtggaagaagcgggtggaaaagtcacggattataaaggaaaaccggtggatatcaccggaaattccgatattgtggcgggaagccagacgatcggggagatcctggtagagaaatatttgtaaaaaagggagtcaacatgactgactcctcttttagggtatcttctgtaaatatatgagtttcatatcctctcgatttttaaaatttttgttctttcgccggatattatatttccggtgtttctaccatagtttttctcgacatcatcctcttttcgttacttgttttcttagtttttatattttctgcttaacaagcataattataaggcgcgttttatatataaacaatataaattcttcttgacaagcatattttatggatggagaacatgcatgaaagcattttggtataacgatgatcgtaaaaatgtatgtggcatcaagatacgagaacttcgcaaggaaaaacatatttccgcaaaaaaattagagattattttttatgtgttatccgactacgtttttgtgcaataattacaaatatcattaaaataacgtctttttgatgacatagtataagcaatatgctaaaatccattcaaagcatgacattctgaattatctacacgggcatatacgccattctattcacagatcaaaatcataagaattttcaatgcttttatcgtccacacatttaagcagggagaattctaaagaaccagagatttctcccagataacacagaggaggagaaatgaatggggacagcggacatcgtaacaaaagagtatatgagggaaaataccgtatttgcggatgcatttaattacctgatctacaatggaaaaaaggtgattgacccggcaaagctgaaagagatcgatccgacagagattgcactgccgtttgatgatgaagcaaaagccggtaaagaaaaagatggtgaagataagaatagaaaagcgcagggaacagagtggagttctgtgaaaaatgaatcggtgagaaagaaaactgccggcagagcaggcaaaaaaacagatgcagtgcagagataccgtgatcttttaaaatttgcggtaatcaaacaggatgaaagaacgtcctatgttcttttgggcatcgaaaaccagacggatgtccattatgcgatgcctgtcagaaatgccatctatgatgccctgcaatatggcagacaggtggcggacatagctgccggacaccgccggaacaaaaaagagctttcgggaaaaaataatggtgagtatctgtccggatttttaaaggaagatcatatcagaccggtgattacgcttgtgattcattttggagcagaggaatgggatggtccgttatcattgcacgaaatgatgtcgacaagagatatggaactcttaagttttgtggagaattaccggattcatctgatcgatccggcgaagttgacggaagaacaactaaataaattttccacaagtatgagggaggttatagggtatatcaagtactcgaaaaataaagataaattgttagaatttttgaggacagatacccatagaagcatagaaatgaatgcggtaagagtgataaagacgatcacgaatacaccgattgaagtatcagaagaagaggaggagatagagatgtgtaaggcaatcgaagatctgatcgcggagagcgaagcacgtggcagagcagagggagaagttcgtggcagagcagaaggagaaacacggggagaagcgaagggcatgatagaaatctgcctcgatatgagtttttccaaagaggatattttgaaaaagttacaggaaaaactaaatatatccctgcagcaggcgggggagtattttgagatgtatgggaaacatattgtttaaaaacaatataaattaatataattcttataaagcatgacattctgaattatctacacaggcatatgcgccattctatgaacagatcgaaatcataagaattttcaatgcttttattactcacatatttaagcagggagaattcttagaaacccaaagatttctcctaaacaacacagaggaggagaaacaaatggggacagcggacatggtaacaaaagagtatatgcgggaaaatgccgtatttgcagatgcgtttaattatctgatctacaatgggaaaaaggtgattgatccggcaaagctgaaagagattgatccgacagagattgcattgccgtttggtgatgaagaaaaagccggtgaggataagaaagggaaagtgcaggaaacagagtggagttctgtgaaaaatggatctgtgagaaagaaaactgccggcagagcaggaaaaaaacagatgcggtgcagaaataccgcgatattttaaaatcagcagtcatcaaacaggatgaaaagatgtcgtatgttttattaggtatcgagaaccagacggatgttcattatgcgatgcccgtcagaaatgccatctatgatgccctgcaatatggcagacaggtggcggatatagctgccgaacaccgtcggaacaaaaatgatttttcgggaaaaaataatggtgagtatctgtccggatttttaaaggaagatcatatcagaccggtcatcacacttgtgattcattttggagcagaggaatgggatggtccgttatcattgcacgaaatgatgtcgacaagagatatggaactcttaagttttgtggagaattaccggattcatctgatcgatccggcgaagttgacggaagaacaactaaataaattttccacaagtatgagggaggttatagggtatatcaagtactcgaaaaataaagataaattgttagaatttttgaggacagatgcccatagaagtattgaaatgaatgctgcaagagtgataaggacgattacaaatacaccgatcgaagtatcagaagaagaggaggagatagagatgtgtaaggcaatcgaagatctgatcgcggagagtgaagcgcgtggcagagcagagggagaagttcgtggagaagcgcgtggcagagcagaaggagaaacacgtggagaagcgaagggcatgatagaaatctgcctcgatatgagtttttccaaagaggatattttgaaaaagttacaggaaaaattaaatatatccctgcagcaggcgggggagtattttgagatgtatgggaaaagaacggtgtaattgaattgtacactgacattgcaaaaaacgctgaatccatgataaatcaatggaaacagcgttttggtaaaatctataaaagaaatgttacatttcaaccacagcaacaccccatccgcctaagtcaattttatctccacagacaatggatgtttctgaaaccagttctatgccgtcttttcctcggtgtgtgacagaaaccggatcctttgaatagttcagatagtagcacaattctttaccggaatcattgatacctctttttacaatgagtggataatgcggtgcatctgaggaaagatctccaccggaaaagccggtttcgtgcaggaaagataaaagcacggattctaacagttcatcattttcaaacatcgttccaaaataaagtgtggaaccatttccatattgattttttgcagcagcggcatagcgttcatatgccggatgactgtattttaataccggtacagcggtatcacaggtgataagctccatccattcacaggcggaggaggtcagggaaaaggcagagtcatccggatgtgaaaaatgctcctgtgcagccgccatgacatcgctttgaaccggcacgatatccacatgatgcgggtgtgtaaactgatcgtagtgaagtcccagacattcatgcaggatatgtggctgcatgtccggataaatctttaaatattcatcggaaaaaccgcttcggaatgtggtgatcagatgtccgccgtttctgacataggaatctaatgccagaagcagagattccggtgcactgtagagtgccggtacgatcagacattcatagccggaaaaatcctgttccctagaagaaatcatatcgtactcaatatttaagcggtagagggcatctgaaaaccagcgcatcacagtgttgtagccgttggctccggctttttcaagcggaaactgggtgaatccggtcagcgaggcattatcaagcataatggcgatcttgttttcttttttcaggttttttaaatgaaaaccgatcttattccattcgtttccgatcacgacagcttcacggtaagtctcattttcagaaaaatcgtgggagagcacacctttccagtaactttcaattgcattgtggatcgaatgccagtgccagtacatcacactgttagagccgtttgcgatatggctgtatgcctgcaggcggagctgtcccggataaggaagccacggagtcagtccctgagcctcggtctctaagatcagataattgtcctttttcagactgcgtgagatatttccacatacggtaatttctgcaccggtcagttcctcattagaaggatggtaaatatcggcaccagccactgtcatgcagcgtgaggcatcgtactggtcgacctgggactgataaccgatcgagtgtgtggtccagtcaaaatcaaaattttgtgtgataaactgatcatcccgtttgtactcgcggacaatatcagcctgccagctcaaaaatttagtgacaagtgaacgctgaaatttacaaaattcagcggcaagactctggttgatcgtacctctgacatccgggaaatcatcccagtcattcacacggttgctccagtaatccagtccaaactcatggttaaaatcattgatatccggaaaattttcttttaaataatctacaaacattgcctggacacggggaccggcagttccataacttttggtctcattgtcaagctgatagccgatcacatgcggcacatctttcacatgctccatcagaacgcggatcacacgctctgcgtgggagaggtaatccgggtctgtgatatccatattctggcggtggccatatcgttcgcggccgttctgggtgattgccaggatgtccggatatttttttaccagccatgtcggtacggcataggtcggtgtcccgacgatcacggaaatatggtggcgtgcggcagcgtctaacattctgtcgatatgagtaaaatcatacacgccttcctgcggctctaaagtactccatgttgattccgcgatacggataacattcatgcctgctttttccatcatttccatatccttttccacacggtcgtatggaaggtattcggaatagtatgcagctccaaaataaagtttttctgttttcatataaaacccccaccgccggatgacaggttcgtattgtctggccttagaagcagatttgagcactgtggcggtgatatcctttcttaatttaatataaaatgataaaatgaacaaccgcttgcgcattcttattataccatctgaaaatttacatgtaaacgataagaaacagtttccaaaaaaatatctatgatttactcggatatgttctataaaaaaatggtgtagacagtgaacttttaatttgctaacataaaatcaatactggaagtgtatattgcagggagggtcaaacatatggaattaaatcagaatacagaaaaactggacaattatagaaaacgtgctgcagagctggtcgggaaaatgacactggaagaaaaagtggcacagactctgtatcaggcaccggcggtggaacggttaaatataaaggcttataactggtggaatgaggcattgcacggtgtggcgcgggccggcacggcgacggtatttccacaggcaatcggtctggcggcaacatttgatgaggatctgttagagcaggtcggtgatgcagtgtcgacggaggcacgggcaaagtttaacatgcagcaggagggaaaggatacggatatctataaaggcctgactttctggtcaccgaatgtcaatattttcagagatccaagatggggcagaggacatgagacgtttggggaagacccatatctgaccagccgtcttggagtccgctatattgagggtctgcaggggcatgatgaaaattatttaaaggcggctgcatgtgcaaaacattttgcggtacacagcggaccggaagcggtgcgccatgaatttgatgcagaggtgacggagcaggatttaagggaaacatatcttccggcatttgaggcgtgcgtaaaagaaggaaaagtggaggcagtgatgggggcatacaaccggacgaacggagtgccgtgttgtggaaacaaacgtctgctgatcgatattctgagaaaagaatggggattttcggggcatgtgacgtcagactgctgggcaatccgtgatttccatgagggacatcatgtgacaggcactgcgattgaatcggttgcgatggcgatgaataacggctgtgacttaaactgtggtactctgtttggatttttagttcaggcggtgagacagggactggtcaaagaagaacgcttagacgaggctgtcacaaatctgtttatggcgaggatgaaacttggtgtgttcgataaaaaagaagaaaacccatacgataaaatcccttatcttgccgcagacagcagagagatgaaaaaattaaatgaggcggtggcaagacgaaccgttgtcctgctaaaaaataaggagcatatattaccgcttgataaaaataaaataaaaacggttggcgtgatcggaccaaatgcggacagcagacgcgcgttagtcggcaattatgagggaacggcatcacgttacattactgtgttagaggggattgaagattatgtcggcgacgatgtgagggtgctctattcggagggctgccatctttataaggaccgcaccagcaatctggcacaggaaaatgaccgcatgtcagaagtacttggcgtatgcaaggagagtgatgtggttgtcgcagtgctgggacttgacgcgggcattgagggagaagagggagatgccggcaatgagtacggcagtggtgacaaaccggatctgaacctgccgggactgcaggaggagatcttagaggctgctgtatcctgtggcaagcctgttattttagttctgctatcgggaagtgcacttgcggtgaactgggcggatgagcatgtagatgcgatcgtacagggctggtatccgggggcaagaggcggagctgccattgcggatattttatttggggaagcaaacccggaaggaaaactgccggtcacattttaccgtaccacggaagaactgccggatttcgaggactattccatgcagggaagaacttaccggtatatggaacaggaagcattgtatccgtttggctatgggctttcctacacagagtatgcatatcaaaatgtgagatttttagagcaggaaccagtggtgtcagaaggagtgacgatcggtctgtctgtaaaaaataccggaaaaatggatgggactgagacagtgcaggtctacgtgaaggcagaacattcaaagatgccgcatggccagttaaaaaagatcgtaaaacttccactctgtgccggggaagaaaaagaaatcaatatccggctggaatcagaggcatttatgctgtatgatgaaaacggtgaaaagatcctgccgtccggacacttcgagatttttgtcggaggcatgcagccggattcacgcagtgagaaactcacaggaaaaacagtggaaagtctgatgttatgaaaataattgtgcgtctctgtaaaaaaatcgaagaaaaaattgacacttacagcatacaaaagaaactgattcttttgtatgtctgttgtgtggtcctgccggtcgccctgacagacagtgttgtagtcggaatgatattttcggaggaacacaatgcaagaaaacaggtgacagaaaatatagcgagtgtggcagagtacagcattgacaaggcagtagaagaagcactcacaatctcaaaaaatatttatatgaataagtatatcaacaattttctgaatgccgattatgattcccatctggcattttatgaagcgtatcaggagctgatgcaggattccctgtttgacagttcgcttggcaacagcagcgttgagatcacgatgtatgccgacaatgatacgatcgtaaatggtggaaagttcaaaaagttaggacgtgtaaaacagacggaatggtatcagaaactgcaggattccgggaacaattttgtattttgtgcctacatggatgaaacgcacgatacatctccgacggatttaagaaaggtgtcgattatccggaaattaaaccgttatatgttagatccgcatgaaaaagttttaaagattgatctggattataatgcggtcaataccggacttttgagggcaaattatgaatcagaggtgtatatctgcagcggtgataagattatcttttcaaataccggaagaaacaatataaaagaatcttttgagaggtttgataagggtaccatgcacaagtgttatgtgcaggagaaagaattatacggacagccgatgaagatctatgtgcggtatccggaaatacagatctcaaaaattttgtggaacaatgccataccgatgatcctgctggtgttgatcaatatttttctcccgtgggtatttatgcagtttctaaaccgttcgtttacagtacgtctgcatctgttggaagataccttttcgcaggatcataccggaaaattaaaagtggtggaaacaatatcaggaaccgatgagatcagccagctgatgcagcattataattccatggcaaaccggatgaatcatctgatcgagacggtttatgagagcaggttaaaacagcaggagtcggagattgccagacaggatgctgatattgccagacaaaaggcggaacttctggcacttcacagccagatcaacccgcattttctattcaatgtattggaaaatatccgcatgcggagcatcttaaaacatgaggatgagacagcggaaatgatcgaacagctttcgctgatagaacggcagtatgtggagtggggaacagatattgtgagccttggtgcggagatcggttttgtggagtcgtatttaaaacttcagaaataccgttttggtgaccggctaagatacagcattgaaatggaggatgactgcagggagtaccagattcctaaattatcgttagtgacttttacggaaaattcatgtgtgcatggtattgagggaaaagcgtcacagtcatggatctttgtccgtgtatataaagataaaaataatctgcatcttgaagtggaggataccggggaggggatgccggaagaatatctgaattatctgcaggaacgcatggaagaggcaaatatcgagatgcttaaagaaaaaggacgggtaggtgtgatcaatgcctgcgtgagactgaaaatgtatacaggagatcatgtaaaatttcatatcgaaagtgaaagaggtgttggaacagaagtatctgtagtgatacctttgaatgcaatttcataaaaaggagaagatagggaaaattttatgggagaaagaatggaggggatagaatgcttaaagtgctgcttgtggacgatgagccatttatcgtacagggactttctgcgttgattgactgggaaaaagaaggatttgagattgtgggaactgcggggaatggcagtgaggcggtagaatttttaaagagtaatccggtcgacctgatcttagcggatatcaaaatgccggttatgaatggtctggaatttttaaaatatatcagggaaacgcatctgtcagaggcattttttgtaatactgagcggttatggagactttacctatgcgaaagaggcaatcaaatggcagtgtacggattacatattaaagccgatccagaaaagccagctccttgcactgctttcaaaggtaaaacagatgcagcaggataaaaaggaagagagcgagcgaatccggaaaatcggaaaagcgtattttgtgcagcagatgcagacacttttgctcggcagacaggaggaaacggcactctcttatgttaaaggacaggtggattttggaagagggatccgctatatcgggatcgagtcggaggatggcgagacggatacggacataggaccggaaaagaaacggcagctccagagacagatatatgaagcctgcatgcagtatcttggaggtgaatacagctgtcttacattcttagacgcggaaggcaaggaagaatgttatgatgtgggatttattttctgtaaaaaaatttcgcaggaaaagggactgcgggagcaggaatatatcaatctgctattggaaaagattcagaaaagcacagtccatccggtcgtgatgtatgtcggcagtgaggtggaagatatcagtgatatctcagaatctttccggtcggcagtgatcgcaaagactttttccaattttaaggtgatgccgaatctattgtactattcgaaagagcagaaaaatccgtccggtattgtggtgagccacaaaaaaatcgaggatctgctgcggagtgtggaagagaatgacaagaaaaggatcgaggataatgttgcagcgatctatgaggagatgaatgaggcgggaatgaacccggaattggtacagatgaacatgaattatctcctgtaccgtctggtttcccttgcgatggagcaggatgacagcgtcaatcaggatgaggtgttacagtatatctgcgaaaatgcgtttcaggtacatatgatccgaggaagcctttcacatttccgcagattcgtcatggagtatgcggattatctggtacagttaaggcagaatgcgtcccgcggtgtgcttcttgatgtggagggggagatccggaaaaattatgcagagaatctgacgctcaaagaactcgggaagaaatattttgtcaacagtgcttatttagggcagatgttccggaaaaaatatggtgtatcgttcaaggaatatctgaataattacaggatcgagcgggcagcggagatccttcttaggacggatgataaaatctatcttgtggcggaagaagtaggataccgtgatctggattactttattaaccggtttatccagagcaaaggatgtacgccgacaacgtaccgcaagaagacacgcagtgtaaatgaataaacgaggacaatagtacctgtgatagagagtcatgacagattttagatgaaaaactaaaatttgtcatgactttttttgatttttgtccggttgtagaaaaatgacaaattggtaaaataaaattacaaaatctgatacagatcttacagaaatcagatgtgattaagaaggaggagaaaaaatgaaacgaagaaaagcagtgtcagtattgcttgttatggcaatggcagcgtcaatgcttaccggatgtggcgggggaaataccaataccacaggaacaaatggcgcagcatccacagagggaggctcatcaggggaaaacacaaatgattcatccggcgtgaaagagtttaccgcattttttgcagtacctggtacagagatcaatgatgacaatgagatcgagcagaagatcgcagagatcacaggtgcaaaatgcaaggagacatggctgaccggacagacagcacaggaggcagtcggaacactgatcgcaggcggtgagtatccggatatgatcgatggcggcgacggaatgaaacagctctatgatgcgggtgcgctggtagcactggatgattacatagacaaatatccaaacatcaaagaattttttacagatgaggagtgggataaactccgtcaggatgatggacatatctactggatcaatcagtttggaaatatttacggggaagaaaaagcaaccacccacggtgacgaggcattctggatccagacgagagtgttaaagtgggcagactatcctgagatccatacgatggatcagtattttgacctgatcgagaaatacaatgaagcaaatccgaccatggatgacggaacagaaaatatcccgtacacgatcctctgcgatgactggagatacttctgtctggaaaatgcaccacagtttttggatggctatccaaatgatggaagttgtatcgtagacccggatgaattaaagatcgtagattacaatacaacaccgacagcaaaacgttacttccagaaattaaatgaagagtaccagaaaggaatcgtagatccggagtcttttacacagacctatgatgagtacattgcaaaattatcaaccggtcgtgtacttggaatgatcgatcagtggtgggattttgcatacaacgtaaatgatgcatttaagcagcagggacttgacaaggaaggctgcaattatgtaccgcttccgatcacgatcgacgaaggtatgaagaaccagtggcacaactccggcggaacattaaatgtgtcaagtggtcttgcaatcaccacaagctgcgaagacgtggagggcgcccttcagttcatcaatgatctgttagaccaggaagtacatgatcttcgtttctggggcgaaaaaggtgtggattatgatgtggatgaaaatggtgagtattatcgtaccgaggatatgagaatgcagtcctccgacaccgcttacaaggcatcccacagctgttcatattcttatttcccacagtattccggtaccagccgtgacggcattaatgcaatgaaatcgggggatcaggcaaaagagttctatgacggattgagcgaggacgtacagaactgctttaaagcatatggcgcagagacttatgtggatatgcttggaaccagcgaggcaccgggaccgtggtatccgatgtattcctattcaaacaacatgacgactgcaactgagggcggcatggcatggacaaagatgggcgaagtaaaacatgaataccttccgaaggtcgttatggcatctgactttgacagtgcatgggaagagtacatgggtgtctacaataactgtaatccgcaggcatttattgatgagatgcaggcagaattagaccgcagaattgaggaagcaaaaaaatatcagtaaaaattgtgagaaaacgggatggggactggacgaatgacagtccccattcttaaaaaagaggagtgaaactatggcttcaataacagtaacgaaaaaaaaacaaaaacaaaaaatcaaagagccgcagataaaaatcacatggaaagaaataaagcggcagaaggttcttttaatatggtcagcgatcatcgtagtgtatggagtgatcttctgttatctgcctcttggcggctggctgatggcttttcagaattataaaccgaaggatggcctgcttcattcttcttttgtgggacttgcaaaattccagcagttattttccgatgcaacctttttgcgggtaatcagaaatacacttgccatgggtgtgatcaatctggtcgtcacctttgtgatggcgatcgtatttgcaattttattgaacgaggtaaaatcacagggaggaaaaaaggtcgtacagaccatttcttatctgccgcatttcctttcctggattattgttaccggtattttacatgatgcattatcgggcaccggtattatcaacgaacttttagtgaactttggtattttagaccagcctctcaacttctttgcatatccgaaatacttctggccgatcgtggcatttgcaaatgtatggaaagagacaggatggaatgcgatcatctatttatctgcgatcacagcaatcgatccttcactctatgaagctgcaaatatggatggtgcgggccgctgggcaagaatcaaatatgtcacacttcccggaattaagccgacgatcatgatcttacttttaatgaatgtcggaaacgtactgaatgcaggttttgagatccagtatctgcttggaaacggtctggtacagagcgtatcgcagaccatcgatatttatgtattaaaatggggcatcagccagaatgatttctccattggtacggcagccggtattttcaagagtctggttagtatcattctgatcgtgatcgccaatcagatcgcaaaacgtaacggcgaagaaaggctgttttagggggtattggtatggaagcagtaacaacaaagagaagaaaatcaagaaagaaaacatccgttgcggacaaagttttcgtaacgttaaatacattatttatgatcatgtttgtgatcattacgttatatccggtgttaaatacgctggcaatctcactgaatgacggaacagatgcgctgcgcggcgggatctacctgctgccgagaaaatttacatggaaaaattatattaccgtgctgcagaaagacaacctgattatgggtgcctacatcacggttgcaagaaccgtcatcggaacagcacttgcactgtttgccaacgcgattctggcatttattgtcagcagaaaacgtttcatgtttaaaaaacagttatccctgttctgggtgatcaccatgtatgtcaatggtggaatgatcccgaccttcctgttatttaagacacttcacctgacaaacagtttctgggtgtatgtcattccgggaatgttcagcgcatttaacatgttagtcatccgtacttatatgaatggtatctcagacagtctggaagaatccgcgcagttagacggggcaggttacaccacgatcttcttaaagatcatttccccgctctgcaaaccggtatatgcgacggttgcactgtttgtcgcagtcggacagtggaattcatggtttgatgcaatgctctataaccgtatgagtgcgaacctgacaactttacagtatgagctgatgaaattattatcttccgtcacaaaccagggaaattccgtggaggcaatgaaaaatgcggcaggatctgtgacaccgacttccgtgcgtgccgctgcaacgatactgactatgctgccgatcatctgtctgtatccgttcttacagaggtattttgtgacaggacttaccattggcggtgtcaaggaataagaggaaaggataaagttgcatgaaaagaggagcgtttgagactggaacttaccgcaatgtatttgcggaggcaggctatgataaggaaaccatagaaaagcggaaaaatgagatcttccatacacttttttacggggcagaatcagagcggatctatcatcccgtcgaggacgatatggcatatatcgaggacacgggtaaccatgatgcgcggacagaagggatgtcctacggcatgatgatgtgtgtccagatggaccggaaagaagaatttgaccgcctgtggaaatgggcaaaaacttatatgtacttagaggaaggcgaaaatgcaggatattttgcatggtcggtgcagctggatggaacaaaaaattcttttggcgcagcaccggatggtgaggaattttttgcgatggcactgtttttcgcagcgcaccgctggggagacggcgaaggaatattcaattacagcagggaagcgaaagagttgctgcacacctgcatccacaagggagaaaacggagagggtggcagagccatgtgggatgcctcaaatcatctgatccgttttatcacggatgtggatttttcggatccgtcctatcatctgcctcatttttatgagttgttcgcactgtgggcaaaagaagaggaccgggcattttttaaggaggcggcggaggcgagccgtaattacttaaagcgtgcatgtcatccggtcactggtcttagtgcggaatatgcagaatttgacggaacaccgtatcagcctgttttagaccagtggggaggcagacatgactggtattacagtgatgcctaccggacgatcgcaaacattgcccttgactatgagtggtttgcaaaggatgagtgggagagtgagaatgttgaccggtttttgaattttttctgtgataccgtgcaggagaaagacagggacggtattttcctgaccgacggaaccattctggaaggaaaggcactgcatccggttgcgatgactgcggtcaatgcgcaggcggcacttgcctcagaccagaaaaatgcatttctctgtgtccaccgtttctgggagacaccgcttcgcactggggacagaagatattatgacaactgtctgtatttcttcgcatatctggcactgagcggcaattatagaatttattaggagtgctcgtatggaagcaattttggtaaaggatcaaaaagcggcggcatttgtgatggaggatgggacatttgagggtgtctatagaatcacagaaaaggtttgtggggatgtggagcaggtcacaggtgtccgcccgaagatcataaaatggcagggagagttgcagccggcgcaggtgtatgtggcaacgctcggaaacagtgagatgtcagaggcgatcgcagaagaggaagggatagaactttcctctctgtgtggaaagcgggaatgttttctgtttcaggtgttgaaaaatggcagtctgctgatcgcaggaagtgacaagcggggaacaatctatgggttattccatatctcagagcttatgggggtatcgccgtttgtccactttgcagatgtggtccctgccccgcagaaagaaatcattttttccgaaaaagactcgatgcagagcaaagaaccctccgtgaaataccgggggttttttatcaatgatgaatggcctgcgttcggaaactggacattttcccattatggtggatttactgcagaaatgtatgacctgatctttgagacactgcttcggctgaaaggaaattatctgtggccggcaatgtggacatcgtctttttcactggatggaccgggggaggaaaatgcccgccttgcagactgctacgggatcgtgatgagcaattcccaccatgaaccatgtttaagacacagcgaagaatgggatctggtgcgtggagaggattctgtttatggaaatgagtggagctatcttaccaaccgtgagggactgatccgttactggcgcgacgggcttttgcgcagtggaaaatatgaaaatatcatcacgatcggcatgcgtggggagagagattctctgatgcttggggaggatgcatccttagagcagaatatttccctgttaaaagagatcatcacagaacagagaaaactcatccgggaatgtgtcggggagaatgaaccggaaatgctcgcactttataaagaagtggaggcttattattacggggatgagacaacgccggggcttaaagactgggatggcttagacggtgtgacgctgatgctctgcgaggataactatggaaatatgcggacacttccgacggaggaaatgcgctcccaccgcgggggctttggcatgtattatcactttgattaccacggatcgccggtctcttatgagtgggtgaacagttcttatctgcctaaaatctgggatcagatgacgatggcatatgactttggtgtgcgggatatctggatcgtcaatgtcggtgatctgaaatttcaggagtatccgctcagtttctttatggatctcgcatatgattatgagaaatggggaagcagcaggattcatgcgccgcaggattatcttgcgtactgggtgaaacgtgaatttggtggatggttctatgaggcgcagcaggatgcagtttatcggatcatgcagcagtatacaaaaatgaatcataactgcaagccggaagagatgctgccggctttctgggaactggtatattacccggcaatgggaagtgcaaacgcatctgatatgcagctttatgcaggaaaaaattcattttttgcaaaaatgggagcggtatgtgcaaatgattatgcagaaaaaataaaagcatgtatcgaaaaagaccgtttactcacagaacggtttcatcagcttctggatggaaaatgggatggaatggcactctcagagcacatcggctttgtgaactggaacgatgaggagtgcaggtatccgctcatgaccttcatagaaccggcaaataagccgaggatctttgccatgtcagagggcggtgatgtctgtacggcaggcggggactggacgaaaaaattgatcgtgatgcggcagtttttagatccggctgtcagtgaagcctccctgttattgtttggcggctcgaaagaaaaagtgccttatcatatcgagtgcaaaagtccgtgggttctgcctggaaaaatgcagggagtcacagaccgtgaggaagtgctcacggtgcagataaaaagagatgagatcacagactgggagaatgaccacaggacatatgattttgaggtttgctatgagggtggaaggataccggtaaaaattttgctggaaaaagatctgccgggatgtccggcggaggcattttatgagacagacgggatgctctctgtcgaggcagagcactttatctgcaatgaaaaggcggatgcgggagcattttatgttttgccggagtacggaaaaacgttatctggtgtgaaagcatatccgcagacaaagactttttttgaaatggcagagcagatcagacaggcaccaaaactgacgtatcagatctatgtcagggaggcgggagaatacgaaatgatttgctataccgctccggcaaatccggtctgtcagggaggcagtgtctattttggctgcgccgtcaatggaaatgcaccgcaaaagatagagatgattccggatggataccgttccggcgagccgtcctgtgcggaatgggcgaaaatggtggtggatcagatccgcgttgtccgtgtgcaggtcacgctgcagagcggagagaatgaaattggaatttatgcggggacaccgggatttctgctggaaaaactgacgtttgtgcgcaagggaaagcatttgccggagtcaggtcttggactgccggagagaaggaggacgaacagatgagtggacctgtggcaccgaaagatccggaaaaagacagatcttatttttacattatgaaagaaaaagaaacctttggctcactccagacgcagggggagtatcagggcaggggagtccagtttatctacgagagtgatggaaggcttgaaagcagtgcggaagtgaccggtgaggtctgtgatgaagaaattttaaagaaacttggcacggtggagggctttaaaagcctggtgcacagcatcggtatatccgtggagatggaacatagcagagaaccggtcacatttgtatttcagatgtacgggaaagaggatctctacggcggcggaacgctcatagaaacagaactgcgcggggacggcgcagaagtcaggatcccgcttgatacggtagagtggaaaacagatgatgatgtgccggggcagatccggtttgtctttgagacgccggaacagtctgcaagggtcaatgtccgtttctttttaaaggatggatttttcgtaccaaagccgcaggaagagcgcgtggtggatatggaatcccacggatatcaggaaatgatagagcggtcactcctttctatgggagatgcgggcaggatcagaagagtcgtagaaaaagcgcgggctggggagccggtaaccatagcatatataggaggatccatcacgcagggagccggggcagttccgcttcacacacagtgctacgcataccggtcctggaaggcatttgccggaaaatacggaaaaaataacaatgtgaaactgataaaagcgggagtgggcggaaccccgtcagagcttgggatgatccgttttgagagggatgtcctgcgggatggaaaagaaaagccggatctggtagtcgtggaatttgcagtaaatgacgagggggatgagacaaagggaaggtgttatgagagccttgtaacaaaaattttatccatgccggatgcaccggctgtcctgttattgtttgctgtttttgcaaatgactggaacttacaggaacgccttgctccggtgggagagcggtatcagctcccgatggtaagcatccgggatgccgtgacaccgcagtttcggcaggcaaaggacagagttgtttcaaaaaatcagttcttttatgatgcgtttcacccgacaaatctgggacataaaatcatggcagactgtctgatgtatctgattgaccgggcggtctgtgagcctgatattttaagaagaatgcatgaaaaaccggtttatggggatgaatttgcgcaagtgaaattattagaccgcagagacggctatgaacgtgcgaagatctgctgtggcgcattttccggtacagatcaggaattacagtgtgtggagatggatgacagtttaacgccggttcctgaatttccgtacaattggcagtatgatggggcaaatggcagatcagaagatgcattccagatggatatctactgccggtcactgcttctcatctttaaagattccggagcggtggacgccggacgggcagatgtgtttgtggacgataccaaagttctgaccgcagatccgcatgtgaacggctggacgcactgcaatccggtcattcttctggaagaaaaagaaagcggatggcatcaggtgaggattcagatgacacctggggaagaagaaaagaaatttacaatacttggttttggctatgtggaataaaaaaggcatggctgcctggaaagcagagaaatttgtgtgaaaaataagattttagaatagtagaaatggagcgataaaatgagtatagcaaagaatccggttctgtccggtttttatccagacccatctatctgtagggtgggggaagattattatatggtaaattcgagttttgcatattttccggggattcctgtgtttcatagcagggatttagcgcactgggagcagatcggcaatgcgttggacagggaagaacagcttccactgtccggcagtgagatctcacgggggatctttgcaccgacgatccgttaccacgagggtacttattacatcataacaacaaatgtggatcatggtggaaactttgtgataacggcacaggaccccaaagggccgtggtcagttccacattatctgggagatgcggcggaggggattgatccgagcctcttttttgatgaagatgggaaatgttattatgtcgggacaagaccgaatccgtccggggtcagacacaatggtgactgggagatctggatagaggagctggatcttcatgcaatgtgcttaaaaggtgcggggacggcggtctggaaaggtgcattaaaagattgtatctggccggagggaccgcacctttacaaaaaagacggctggtattatctgatgatcgcagagggcggtacgggaccggaacacagcatcagtatcgcgagaagcaggtcgttaagagaatggttctgtggatgcaagagaaatccaattttcacgcaccgcaatcttggcagggattatccggtgatctatgcaggacacggagatcttgtggatgatgcagacggaaactggtatgtcgtcatgcttgcatcgaggccatgtgagggacactgtagtattggcagggaaacttttctggcaaaagtggaatgggaggacggatggcccgtcatcaatccggggattggacatctgacagagaaaacagaacttccgatcggtgagtatcgcctggaaagggaagtgacccacgcggattttattgcatttgatcagaaaaaaatagatgacagactcctgtcgctgcagagaagggatgaaaatgcatattcactgatcgagagaaaaggttttctcaggatgcatctgaaaaaacagaaacttacagagaaaacggacgcgcagtatttcgggctgcggcagaaagattatgattttacattttcggcatgcatggaatttgatgcggagcgggaaaatgaacaggcggggatcgtctgctatcagaatcatgcaaatcatctttcgatgcgcatctgcggtggaaaagagaagagaaagctgcaggtaatcgcacatataacagaaaacgatacgctgcttgcggaagaagaaatcaatgcaaaaggaatgctggaactgtatttgaaggcagcaggacagagggcagaattttttgtcagagatgaggaaggaaaggtattaaaactcattaaagacgtgagcctgctgccgtacagtacagaggaagcagggggatttgtgggctgcacgctcggtgtgtatgcgtcttcaaacggtgaaatgtcggatcgttttgcggatgtagcatggatttcgtatgagggaataccgggttgatgccgggaaaaaatagaaaaaaataggattgatttttgcccctgtttgtacaataataaacttagttgcgcaactaagcgcaaaaagcgaggaatgagagtttatggataaggggttagaaaagaatattacgattgcggacgtggcggaggcgcttggagtatcgaagacaaccgtgtcacgtgcaatttccggtaaaggtcgtattggcagggagacaagagagcgcgtgctcgcctacatagaagaacatgattataagccgaatgtcattgcgaaagggcttgcgcagtctaaaacttataatatctgtgtggtcatgccgggggagtatgatgttgtggatcttacattttttcaggaatgtctgtttgggatacaggagattgcgggcagcatggaatatgatatcctgctttctatctgcaggaaaaacgatatatcttctcttgagcgtatcatagcaaaccataaagtggacggtgtgatcctgatgcgcacttttgtggaagatgaacagatcgattttctgcagacaaaaaatgtaccgtttgtcacgatcggaagtaccagtgccaattacaaaggcgtgattcagatcgatcacaatcacaagagtgcatgcaaagagcttacatcgatcattttgatgaagcagatggacaaaattgcactgatcggcggcaatgaagagcatgtggttacacagagccgtctgcggggatttcgtgaggcatatgcgaagatggggaaaacgttagatgtggatctgatgtttttaagccaggataaccaggttctggtggaaaaggcagtcaaggaagcattaaacagacaggcagactgcatcctctgtatggatgacgctgtctgcagccgtgttttaaagacactgcgccagcagcatgtcaaagtgccggaagatgtccgggtggcatcgttttataacagcatggtacttgaaaacaatgttccctcgatcacatcgctttcatttgatgcaaaggaactcggcatggtggcatgccgtacactgcttgatctgacggagggacttgaggtgaaagagcgcacattgcttccgtatgaggtggtgctgaaggaatcgacgaaataaatataatcaggaaaatacagttctgagaaaattgaagatcatcctattggagagaataagcaatgggcgaaacacatagcgaataaatgtgtttcgcccgttttttatgctgaaattgtcggaaataacgtgaaatgggcgaaatgattataatgattaccggaataacccacagatcaggggaaatgagggtgaaactgaagcaatatcagggaaattcgcccaaaacaaaggaaaaggcaggaaaatccctgattcaaaaaatatcaaaaacgagccaaaatatccataaaaagatgatataagaattgaaaatgcacggaaaatcaatggttaacggttgcgcaaaagtcgaatttgaaaaaaataaaagaaaaaatagaagatgatattgtgcaaaatggctaaaaaatggtcggatttattataaaatgtggatattgacacaaggatgtgacggagatatactctaaccatagaacaaccgattgcgcatagcgcaacacgaaaaagtgttctaaaagaacaattttttctatcaaggaaaagggaggaattttcaaatgaagaaaaaagtcatcagcacagtattatgtgcagcaatggtagcatccatgtttgcaggatgtggaaacaaagcagccgataacagcagcgcagcagacaatagcgcagcagacaacagcgcagcagagagcacaaacagtgcagcagcaacagagacaggtgatgctgcagataatgcagaaacagcttccggtgatgcaatcgcaaatctgatcgcatctacagatggaaccgtagatatccagctctggtgttcagaacttgaggcttatcagaacgttatgaaagagctgacagacaaatttaaagagcagtactcagatgtagattttaacatcacgatcggtgctgtatctgaggcagatgcaaaagataagattcttgaggatatcgatgcagcagcagatgtattcgtatttgcagatgatcaggtaaatgatcttgtaaatgcaggtgcgcttcaggaagtggcagctacttatacatatgatccgaaagaaacaaactcagaggcaactgtagcagcagctaccaaagacggaaaactttacgcttatccgttaacagcatcgaatggttacttcttatactatgattcaaatatcttctctgaagaggatgtggcttcctgggaaaaccttacagcaaaagcggaagaagcaggaacaaaagttggcatgaatgtagcagatggatggtatctgtatggattcttctctggtgcaggctgtgaactttccatgaatgaagataactcaaacaactgtgactggaactctgagaccggtcttgcagtagcacagagtattgagaatatcacttcttccccggcatttgtaagcgtacaagatcaggatgcaattaccatgttaaatgacggtacacttggcgcatatgtttccggtacatggaacaccggatcttttgaagcgaaatacggtgacggatatgcagcatgtaaattacctactttcgatgtaaatggaacagctacacagatgggatcttatgcaggatacaaattcgtaggtgttaactcccatgctaaaaatgttggctggtcaatgctccttgctgagtatctcacaaatgaggagagccagttagcaattggtaacgctacatcagagggaccggctaacacagtagcagcagctcagattgattccccggcacttgcagcacttgcagcgcagtcagagtttgcagatcagcaggttgtaggcaataattactgggatccggcaaaggcacttggacagaacctggttgacggtgcaacagatcttcaggctgtacttgatgatgcagtagctggtattacacagccggtagctgaataatcaaatatctgtaaaactcagatttccacatggctttggaataacttttatgaggagggcattatctcctgccagacaggatattgctttccggcagaggcggatattttcctgctggaaaccaatgctttccttgtgacaggctatgtggaaatttttaaaaaagagaaaagtttttgcgacttagcccaaaattctcattcacgcgcatagggagtgaatctatgaaaacatttttaaacacaatcaaaaaatactttgtcgatttcggaacagcagtggcaaagggagatatctggtgcaagctttcactgcttgttatgggtgcaggatactggggacggaaacagatcgtcaaaggtgtcttaataacagcccttgaagtggtagtgatcctgtttacaggaatgttctctatcaattatattaaggatttaaatacacttggtaccgttcagtatgagtccgtatttgatccgctgaccttgaaaaatactgttaatgattacgataactcattgctgatcctgctatatggtattattggtattctcgtaatcgtagcattcatatttttatatataagcaatatgaaagctgtttaccggcttcagcttatgaaagaagagggagaacatgtcaatacatttgcagaagatataaaatctcttttcaacggtaagttttatatcacattacttaccctgccgagtatcggtgttattatgatgaacattataccgatcatttttatgtcctgtgtggcatttaccaattatgatatggatcatatgccgccaaactacctgtttacatgggttggacttagaaacttcaagaatatgtttacaggcggcaccacaatcacattctcctatgcattcgtaagaattcttgcatggacaatgatctgggcagtatcggcaacatttacaactttcatcggtggtattcttttggcaaagctgatcaaccatgaagatacacattttaaaaaaatgtggagatcactttttgttgtgacaatcgcgattccacagttcgtaacattgcttcttgtaagcaaaatgttcagcgaccacggtattgtaaatacattatgttccaacatcggtctgacaggatggttacaaagtatcggacttgtttccggaaactatattccgtttctctctaaaccgggctggtctcatgcaatgatcattcttattaatatctgggtcggtgttccatatcagatgctttccgctaccggtattctgatgaatattccgacagatcagttggagagtgcacgtatcgatggtgcaaataaatggcagatcttctggaagatcacaatgccgtatgtattatttatctgtggaccatccctgattcagagcattattgcaaacatcaataactttaacgttatttatctgctgacaagttccaatgcaacagcaaacatggcatttgcaaactctaatgcaaaagagacagaccttctcattacatggctgtttacattgaccaacgataactcaaactataagatggcatcggtaattggtattatttcatttgctatctgtgcgcttcttacattgcttagctatacaagaatgatcagtggtgataaagaggaggtgtaccaataatgaaaaagaaaacatggaaaatcattgtaagacatttagtacttgctcttttggcaatcatctggctgattccgattgtatggctggttgtaacatccctttccactacaaagggtgtaagttaccagcacttttttccggaacactggacactggcaaactatcatcaactgttcttcaagacagatacagcagcaaacttccctgcatggtttaaaaatacttttatcgtagcattttttacctgcatcgtttcatccgcttttgtactgatggtctcttatgcattcagttgtatgagattcaaggcgagaaaacctctgatgagcttttctatcattcttggaatgttcccgggtgtactttccatgatcgctgtttattttgttttaaaaatgatcggacttactgattcacttgcaggtctggttatcgtatattctgcaggttcgggacttgggtttttagtattgaaaggcttctttgataccataccggtttcactgagagaggctgcccgcttagagggtgcttccgaggcaacaatttttggaaaaatcattattccattgtcaaaaccgatgatagtatatacgatcatcaactctttcctgaatccatggatggattttgttctggcacgaatcatgatcaagtccaaagagtccgcagactggactgttgcgatcggtctttacaacctgttacagaagacattaatcggagattacttctcaatcttctgtgcaggcggtgttatgattgcaatcccgatttccattctcttcgtagtgatgcagaagttctatgttgagggtgttaccggtggagctgtaaaaggttagaaaaatatttttagaggagaaagaaaaaaatggataaatttgtactgaatcttattcatcgtccggagatggttccagagtattctgcaacagtgactggacagggaaaagaagaggatatcggagataaggcactgctgacagagtctttggatatctttaagacacagcagagattagctcacgagaatggattaaaggtaaccattcagatgacatacgcttcactgttcaatgatgaggcagtggagattgcaaaacatgaccatgaggtatatggcgacgagatcgcattatctttattaggacttccttgtgaggagttccgtgaaaaatataagaccaaggatttctgtatctggatgttttccatggaagataagaaagccatcgtaaatgatgtattcgagaaattccatgacagattcggtttttatccggaatccacaggttcttattatatggatgctgacctgacaaattatatcaaggcagcatacccgactgtaaaatgtgcagttgctacctgctgggaggaaggcccgaaggcatatcacacctgcaacaactcctggtatacattatttgatggcggcccatgggcaccatggatcccatccaaacagaacacacatgcaccggctgcaaataaagaggaagacagtggtatcgtagcgatccctcatctttcccgtgatctgatcgcatgttacgatggaaatggttcgaacttcggaacacatccgcagaacgtactccgtggtatgatctatgacacaaagacatgggagtatccatatctttacaatctgatcgaccagtaccgttccttagagaaatataacaacggatattcctacaacatgatgttcgttggaccgggctggatgaacaagatgggacgctgggagcagccatatgaacttctttacaaatcctacagcgatggctgtgcttactacggcaaactgaaaaaagagggtcagttagtagatatgaccatgtcggagttcgctgattattatcgtgagaagaaaggtgtcaaccagaacaattacaacgagccggaatgtgctctctggagagatatcttatatggttccgacaaacagttattctggtactgcgatccatacatgagagcatgtgtcaacatggatcagggcggtgcgatcgttgaccttcgtccttatgcagcaaaattagagtggccggtcggcatcggaacaaaacatgttcaggatgcatcctacccattcttaattcaggagaaataccgtgcaggttatttcacccactatgcaggagagggaaccgtaagaagtgcaaaactttcttacaaaggagaggaagtggatctctgcctctgcccgacacatgcacatttctcacaggaaggaaagacaagaatccttacattagacccggttacgatcgagttcagggatctgactgtaaaacttcagacaaaagagtactttgaggaaggttcttcgaacatcaggatcgagcgtcacattttagagatgagtgatccgactgcggaagtaacattaaatgaatacatggttgcatgctatggtacaactgagtattccgaagatatgagtcatatcacattaaagatcgacggaccggaagagaagacgatcaactatgaatacaaatgccgtgaggaaggcgttgtgggagctgcagaggtttccgcagttattcctgaaatcgagacaagagtatccatgacagcatccgatgcagatgcagaaggatatgtaaaagaaggatatgcattctcaccaatgttcacattgggatacagaaaaacaatctcagataaggaggtatttgcaacatggctcaacttggcaaaggcaaattaaattatagatgcccatcctgttttttaagagatctcgacatcgatatgttctacaataaagaaaccggtatttacagctgtatccgctgtcagtaccgcggaacggaagaggacgtattagagaaaaacgaaatgatccgtttccgctataaagcaatgcatgacagaattacaaaatttgattttgactaaattctggtaacagaaacaaaatgactgccgtactgaaatattgtacggcagttttaaaaagaggtaataaccatgggaaaaaagaaaaaagacacaatggaattgaggttttacgaagttccgcagggtgaatatgttctggcacttttaggagacaactggattcgtgattacggacatgatgaaagtaatcttcattttcacaatctcatggaaatcggatattgtaaaaacggtaccggcgagttgatcttaaatgaagagacaaaacgttatgaaccggcaatggtcagtattattccacagaattacccgcatgtgacgatcagtgacattgcggagggaccaagctattgggaatatttattttttgatccgatggtcatgatccaggaattatatccggataatgctgtcatgcaaaaaaaagtattgcagatgatcaatcgtaaggctttatttttccatgagtgggaaaaccgcggaatttccgttcttgtgaagatgctcatggatgaaatgagacagaaaaaaaatcattttaatgattgtgtcagaggtcttttgatcgctttttttgctgaattgctccgcatgtgtgagagcgatgtctcggagaatgaagtaaagaaaaagacaggtgtttcccagatcacggcggcacttgattatgtcaggttagagtatgcaaacaatatccgtgtcgaggaacttgcaaaggcaagccatatgagtgagacacatttcagaagagtctttgaatcttatatgaatatgtcaccgatggattacatcaatctgatgcgggtgcagaaagcctgtgatatcatgaaaaagacaaatgacccgatggatgtggtcgcccagaaagtaggatttaccacgacatccacatttaaccggaacttcaaaaaatatctgaatacatctccgtatcagtggaagatcagtccggaaaattatgagagaaagctgctgaattataatatttccgcattgaagggctggtaaataaatgggcgaaaacgcgtgttttgtgttgagatacagatgcaaaatgcgcatttttccgttaaaatggagataagaaaaagataaggaggacatgacatgtcattcgaaataaaaaagatccatgatccgaagttttttaaggaaaactgcatggcagcacactccgatcatgtggcatatgcgaatgaaacagaagcagaagaaaaaaagagcagcttccggttattactggatggcgtctggaaatttcattatgcgagaaattatgcgcagaccgtcagtgggtttgaggcagaagattttgattgtaaatgctgggaggatattcgggtgccggcacatatccagatggagggctatgatatcccgcagtatgtaaacatccagtatccgtgggatggaagggaagatgtgtggcgcgacgcagtgccgagtgaatttaatccggtggcaagctatgtaaaatattttacactgccggaaggttttagaaaaagcggactttatatttcttttcagggtgtggagagcggttttgcattgtggttaaacggtcattatgtcggatacagtgaggacagtttcaccccgtcagattttgatcttactccgtatgtaaaagagggcgaaaataagctggcagtccaggtgtttaagtggacttcttcaagctggtgcgaggatcaggatttctaccggttctccggtattttccgttcggtttatctgtataccatgccaaaggtgcatgtgtatgatttaaaagtgcagccggttgtcgatgaggcggttttaaatgcagatcttcttgtcacaatgcagatgcgcggcgagggaaaagcaagactgaccctgaccggcagcagaaattattccgttttggaagaaaaagaagaacagattgttttctctgaggagctgccagtctctgagggggaagttcattttgaaaaagaggtgaaaaaaccggatctgtggagtgcggagatcccgaatttatacacgcttacgatcgaatgttttgatcaaaacggggagagaagcgagcttgtcagccaaagaatcggattccgccgttttgaaatgaaagacggtatcatgacattaaatggaaagcgcattgtatttaagggtgtcaaccgtcatgagttcagttccaaaacaggacgtgcagtgacaagggaagaggttttaaaagacatcgttacgatgaaacagaacaacatcaatgcgatccgcacctgccactacccggatgcttccattatatatgatctctgcgatgagtacggactctatatgatcgcggaaaacaatctcgaatcacacggttcatgggatgccgcgatgcatggttctgtgccgaaagatatgatcgttccgggggacaacatggactgggaaccaatgatgcttgaccgcgtcaattcctgttaccagagagataaaaaccatccggcagttctgatctggtcagtcggaaatgaatcttacggcggaaaagtaatttttgacatgtccgaaaaattccgtgccttagatccataccgtctggttcattatgagggaattttcaatgaccgcagatatgaggcgaccagcgatatggaaagccagatgtatacgagcgtggaaaatgtgaaaaaattcctcgccgagcataaggaaaaaccgtttattatgtgtgaatatacacatgcgatgggaaattcctgtggtgccatgcacaaatacacggatctgaccgatacggaaccgagatatcagggcggttttatctgggattacattgaccagtccatcttgaaaaaagaccgctatggaaaagattttcaggcatatggcggcgatttcttagagcgtccgacggattataatttcagtggaaatggaatctgctatggtggagaccgagatccgtccccgaagatgcaggaagtgaaattcaattaccagaatatcagtattctgtttgaaaaggaagggaagtttaccgttgtaaataaaaacctgtttgcaaataccgaccggttccgctgtgtggcagttttacagaaaaacggggttgttgtgaaaaaacaggagatagagacagcagtaccgccgcttagcacgaaggactatgagatcccgtttgccattttgcgtgcagatgataaggatcagaaaaaagacccggatgcagaatacacactcaccgtttcattctggttaaaggaggatatgagctgggcagatgcaggacatgaggtcgcttttggacagaagatttataaaaagatccctgctttccatgcatccgaaaagccgatccgcgtggttcacggcaaggtaaacatcggagtaaaaggcgaagattttgactgcctgttttccatgttgagtgggggacttgtttcctaccgctatgcggggaaagaaatgatcgagaagatcccgatgccgaatttctggagggcaccggtggacaatgataacggaagcatggctccggcgcgctatgcacagtggaagatcgcaagcatgtatatcagtcacagaaacggtgggatgtttgacaatgtcccgaccaaagtggaagaaaaagacaataccgtgacagtcacttacacctattttatgccgacaacaccggcgggcaaatgtcaggtttcctacaccgtttttggtgatggaacgatcgagacaaaactgatgtatgatccggtagagggacttccggatatgccggagtttggaatgatgtttcagttcaatgctgattatgacaacctgacctggtacggcatgggatcggaggaaacttatgcagaccggagacacggcgcaaaacttggaatttacagcaacaaagtggctgacaatatggcaaaatatttagttccgcaggaatgtggcaacaaagtcggtgtgcgatatgcgcgcattgcggatgcaaaaggcaggggaatgatgtttgagggagatgaattaagcttctcggcacttccgtatacaccacatgaacttgaaaatgcagcccatgtttatgaactgccgcaggtacatcacacgattgtccgtgtggcattggcgcagatgggagtcggcggtgatgacagttggggatctttagtgcacccggaataccatattgatgtgacgaaaccgttagaatttacgttccggtttaagggaatatagaaaaggaagaaaatcctctgctcctgcataggcagtcgcatttttcttcgaaaaacaaggaggatttatatgaattttgtaaaaggaatggatttatccacgcttgcagagttggagaagtgtggtgcgaaatattatgacaacggagaggagaaggatctcttagagatcatgaaatcctatgatgtggatacgatccgcatccgtgtatggaatgatccgtggtcagaggccggagaatcttacggtgccggggaaaatgatccaaagacatcgcttgaaatcgcaaaacgtgtgacgaaagccggttttggagtacttttaaatctgcattacagtgatttctgggcagacccgggaaaacagttcaaaccaaaggcgtgggaaagctatggtgtcaaagagctagagcaggcagtctatgattttacgctggagatgatgcatctttatctggagaacggtgtcaacatcacaatggtgcaggttggaaatgaactttccaatggtctgctctggccggaaggcaaagtgccgaattatgacaatattgcagcgtttgtcaatgccggtatccgcgctgtccgaaaagcggatgaagaacgtcttgccggttccatcaaaggcgtatgcccgcagatggaaggtttgtcaaaaattccggtgatgatccatctcgacaacggcggcaacaatgcgctttaccgtgaatggtttgacaattttacaaaacgcggtgaggactttgaactgatcggtctgtcttattatccgttctggcatggttctcttcagatgttaaatgacaacatgaatgatattgccaagcgctacggcaaagatctgatcgtggcagaagtctccatgggatatacgatggacgactacaatgattatgagaaacttgccgatgaggagcgcaagggttatgcgacgaaaccggcgctggttgagaaaatcgaatacccgatgaccgtacagggacagtatgactttatggaagacttcttaaaccgcatcagccatatcgatgatggaaaagggaagggcttcttctactgggagccggcatggatcccggttccgggttccggctgggcaacgcctgcttccttaaaatacatacaggatccgggaccgtgcggcaacgagtgggcaaaccaggcattgtttgattatgagggcaatgcgctgccgacgttaaaactgatccgtgattttaaggcataaaaagcattgctgtctgaagataaaagagtgtatagaaaatcctgcaatatttatgtaaaaatgttgcaggattttttgcactttgttgcagtttgcgtttcagccattgcaaagggattcggatgcgttataataggattatcagagaaaacgaaacaaatgcatcctgcttttccgggaaaggaaaacagacgggatgacgtggaacaaaataagaacaaatgatgtattgtaaaaaggaggatttaagatggtttgggagaacgtactggcaaagtttaaagagttatttggcggcgaaggagagattggtgtttattttgcaccgggacgtgtgaacatgatcggagagcataccgattacaatggcggtcatgtatttccttgtgcactgacgatcggtacttatggtgtggcaagaaaaagaaatgataagaagctgcgtttttattccatgaactttgagcagcttggcgtgttagagtcatcggtagagaatttaaaaccggagaaagaagctgactggacaaattacccgaagggtgtaatgtgggcattcggagaaaaaggcatgaaagtagaacagggtatggatcttgtattattcggaaatatcccgaatggttccggactttcttcttccgcatccgtagaggttttaacaggatttatcttacgcgatatgtttggatttgatgtgacaaatcaggatcttgcactgatcggtcagtattcggaaaataaattcaacggtgtcaactgtggtatcatggatcagtttgctatcgcaatgggcaaagcaggccatgcgatcttccttgacactgcaactttaaaatatgagtatgcaccgatcaaactggagaatgcaaagattgtgatttcctgcagtaataaaaaacgtggactgggcgattccaaatacaatgagcgccgcagtgagtgtgaaaaagcactggcagagttacagaaagttgtctccatcgacgcacttggagatctgacagaggcacagtttgaagaacacaaagatgccatcaaagaggaagtgtgtgtaagacgtgcaaaacatgcagtttatgagaatcagagaacgatcaaagcagtagaggcactgaaaaataatgatgttgccttatttggaaaactgatgaatgaatcccacgtttctctccgcgatgattatgaagtaaccggtattgagctggatactttggttgaggaagcatggaagattgatggtgtgatcggctcaagaatgacaggtgcgggctttggcggatgtacggtcagcatcgtaaaagatgaggctgtggatacctttatcaaagaagtcggtgcagcttatgagaagaagatcggatatgcagcagatttctatgttgttgagattggtgacggtccagtgaaattagcctgatgaaaagaagtttttcatttctgaaaataagaagctcattgaaaataatatagagacttaaaaatatatgtctggcagagtattgcaaagacacgttaaacagtgtagaagtgaggaagaatatgatacaggaaaagattttagagttgacagaatatggtctggtgacaggacttgctgcaccggaagataaaagatttactatcaatcgtctgttagaactttttcaattagatgagttagaagatgaagtcgctgcagcatatgaaaagagagagccgatgacacaggagaccgctgaggatgccttagagggaattctcacagaaatgcttgactatgcggcagagcagggactgatgccggaggatacgatcacataccgtgatctgtttgacacaaagatcatgagcatgctgatgccaagaccaagtgaagtcatcacaaaattccgtggactttacaatcatcagtccgcacaggcggcaaccgattatttttacaaattaagctgtgattcgaactatatccgcagataccgtattaagaaggatctgaaatggactgcagataccgagtttggtaccttggatatcacgatcaatttatcaaaaccggaaaaagatccgaaagcaatcgctgcagcaaaacttgcaaaacagagcggttacccgaaatgcttactctgcaaggaaaatgagggatacgcaggacgtgtgaaccatccggcaagacagaatcacagaatcatcccggtaacgattaatggcagtgactggtttttccagtactctccgtatgtatattacaatgagcactgcattatattcaacggacagcacacaccgatgaaaattgagcgtgcaacgttcggtaaactgcttgatttcgtggaacagttcccacattattttgtaggatcaaacgcagatcttccaattgtcggcggttctattttaagccatgatcatttccagggtggtcattacgaatttgccatggcaaaagcaccggtcgaaaaagaaatctcattcaagggatttgaggatgtaaaagcaggcattgtaaaatggccgatgtccgtgatccgcatcagcgcggagaaaaaagagcgtctgatcgagctggcagataaaattttacttgcatggagaggttatacggacgaggcagcatttatttttgctgagacagacggggaaccacataatacgatcactccgatcgcaagaagacgtggagatttatatgaacttgatctggtactgcgtaacaacattaccacagaagagcatccgcttggtgtttatcatccacatgcaaagctgcaccatatcaagaaagaaaacattggtctgatcgaggttatgggtcttgcagtacttccggcacgtctgaaaaaagagatggcggacttagagcaggcactgcttgacggtacgtccatccgtgaggatgaagttcttgcaaaacatgcagactgggtagaagaattccttccgaaatacggatttacatttggcagcggtttagagggagaggtaaccccggaaaaactgcatgatatcgtgcagacagagatcggtctggtatttaaggaagtattaaaagacgccggtgtttataaatgtaccgaagaaggcagaactgcgttcatgcgtttcgtagacaaagtgaatgcataggaaatcattctgcaaataccagaatgcaaaatttgattaaattttcatctgtgttttttgtccggcaaatttttgtatgcggtgctaggacgaaagagataggcgatttatttgatcagaatgtatatggatttaaaaataaatatgtgataggcatgataggcagatgtcagcatcttcagtgaggatgctggcattttctatctaccaaaattgattttacactcaggcattgtttcacgtttgtcagaggctttgtcagcagtaaaatttgtaccggattcttggaaaacggcatttacttctttatggtgctgtggtaaagtatttagagatcatgttacaggatacgccctgttttagcgaggcaggtgtggtctgtaacatccgaaatgtacacgaatggagatagaactatggtttcaaaaagaatacaaaaagcactgcttggaaattccgcgatccgtgcaatgtttgtggaaggaaaagcgatggcggaaaaatatggtgcggagaatgtctatgatttttcactcggcaatcctgcaacaccggctccggcagcattaaacgacagtatcagagatttgttggatgaggcagataagaaaggagcggcaggttctttagaattgcacggatatatggaaaatgcaggttataaagatgtgcgtgaggcgatcgcggcaaacttaaataaacgttttggtaccgcatttgacgatcataatatcgtgatgacagtcggtgcagcgggaggcctcaatattatttttaaaacggtcttggatcctggtgatgaggtgatcgtgtttgccccgttttttggtgagtaccgtcagtatgcagccaattttaattcagagattgtaacggtaaatccggatcttaagacttttctgccggatctgaacgattttgaggcaaagattacggaaaagaccaaggcactgattgtcaatacgccgaacaatccgaccggtgtcatctataaaccggagacgatggaggcgatcgcttctatcttagaaaagaagcagaaagaatttggacatgacatttacctggtttcggatgagccgtatcgggaactggtttatgatggaaataaagaggattttctgacgaaatattataaaaatacgattgttggatattcgttcagtaaatcgctgtcacttcctggagagcgtatcggttacgtggtagttccgaacgaggcatccgatgctgaagaactgatccgcggtattgaaatttcaaaccgtacgcttggatttgtcaatgcaccatctctgatccagaaagcggttgcaagatgtttagatgagaaaacagatgtttctttctatgatgaaaaccgaacaatgttgtacgatggcttaacggaacttggatttacctgtatcaaaccggaaggagcattttacctgtgggtaaaatccccggtcgataatgaggaagaatttgtggaagagggcaaaaagctgcatcttctgatggtaaagggaagtgcatttggatgtggtggatttgtacgtcttgcttattgtgtttcccatgagacggtcaaaaattcactgcccgcttttgaaaaacttgcacaagtgtatggactgaaataacgcagtgtaaaaaaggaaaattgtagaaatcaacgtaagcatggaggagtagaatgagcagctgggagtcttatgtaagaaaagtagtgccttatgttccgggagaacagccacaggaacagcgtatgataaaattaaatacaaatgaaaatccatatccgccggcaccgggagtgatccgtgcactgaaagaatttgatacagaccggcttcggttatatccggaaccgacctgcaaggttttggtggatgcaatcgcagagtattatggattaaagagcagtcaggtgtttgtcggtgtgggatcggatgatgtgcttgccatgatcttcatgactttttttaattccaaaacaccggtctggttcccggatatcacatattccttttatgatgtctgggcagacatgctgcggattccatatgaggtaaagccgttagatgaaaattttcagattgtaaaagaagattattatggcgaaaatggcggtgtggtttttccaaatccaaatgcaccgacgggaattttaatgccgttgtctgaaatagaggatatcatacaacataaccggaatgtcatcgtggtggtggatgaggcatatatcgattttggcggggagagtgcacttccgttaatcgagaaatatgataatctgctggtagtccagacattttcaaaatcgcgctccatggcaggcatgcgtatcggttatgcgatgggaaatgagaaactgatcaaatatatcaatgatgtgaaatattcattcaattcctataccatgaatcagacagcgcttgcacttggtgtggaagcaatcaaagataaagcctactttgaagagacaagacagcgtgtaatagcaacccgtgaatggacgaagcaggaactcacaaaacttggtttttcatttggcgattccatgagtaattttatcttcgcgacacatgagcgcgtaccggcaaaagaactgtttgaggctttgaaaaaagaacacatttttgtgcggtatttttcgaaggaacgaatcagcaattatctcaggatcagtattggaacgaaggaagagatggaggagctgatccgtttcctgaaaaattatctgcagtgataaaaagtgaactggtcatagttacaaaaactggaaacataaccagaagacactaattggatggataaaaagtatcgtatccggtattttcaaggtacagtggagccgcctgcttttgagccagtcggtttgtgccgaaacgaaagagaatgagaccgctaaaagtacagatcactccggtggcaaaataaagaacgaaaaagagtgtgctgttgccggtcggtaaaatgccgcttataatggttccccagaagttaaacatcatatgaaacaggatagactgataaatactgccgcctttttcacagatgtaacctaagaccatgccgaggaaaaaggcatagattccctggatcatattcatatgaaaaagtccaaataaaagcgcctgcatgatattggctgcccagaatgggaacactctttttgcctgatgcatcgtgacaccgcgaaagagaagctcttcgccgatcggggcaagcaggatggaataaaaaaacatggaaacggtcagtccactgtttattccggtactttccattaatttttcatatgccttcatccactgcggaaacagcgaggctgtgaaagagaccagataggtcgaaaggcactgagtaccgggaactaaaaggatgatcccaacaatggaaagcggatgaaaaacttttcgtggatgaatcagatagattccattatacccggcatgataccagaagccaaatgctccgatacagagaagggaaaatacaatcatgatcagggtatttacacgtgtcgtggaccataaatctaatgttttgttccaaagatctgcgtagatacggttggaagaaaaaatatagcggatatgttcgtaaaacagagtgactcccataacaaaaaacatggcaaggtactgaaatacaagtgcaagtaaaaacggtataaatgtaaagaaaaaagaaccgatttttttcatgtgaatactcctttgcaaggtgaaataactgttagtgatgaaaatattatagcaaacatatgtttgaaaatcaatagaaaagagataaaaacagaacgtatgttcttgaaatgataatctatatatttcattgcatatatggggagaaaatgatataatggcggtctgcgaaaaaaataaaattacataaaatatgtatttactttaaaactttaatatgctaaaatgtatcgtaggtgtatagcgcatatagcgtgtaattaataaaaaaggagaaaggaatatgagcaagaaacttaggacagaggcagtcgatcatctttttgatgctatcttaagcctccagaacaaggaagaatgttatacattttttgaagatgtatgtactgtaaatgagctgctttctttatcacagagatttgaagttgcaaagatgcttagagatcagaaaacgtatctcgatattgcggaaaagaccggtgcttccactgcaacgatcagtcgtgtgaaccgttcattaaattatggaaatgacggatacgacatggttttttcaagacttcaggacatggataaagaatagaaataaaaagaaccgctatttttaatttgcgacaacaggacattctgcaaagtgtgcagcctgttgttccattgaaaatagcggtttttctgttaaatacggtaaaacataacaagtaatctgagcgggaagcatgcagcctgttattttttggatggctttgtctcaggattttttgaagccatctgatcgatcatcttttcaatcagagtttttttgatgtaaacgtcatagctgagcatacagataaagctgaatgtatgcaaaagatctgcttcatcttctgacgcatccgggaatgtgttcatggaagtgttgaatttttttgcgagatctttcatcaggttctgtgtttccggatgttctaaactgaaaacttctttgtagatatcttcgagactgtaattctcgtcattgccgaaatatttttcagtgatcgggtttaaaataccctgaatgtcgctgatgcttaaaatacttttcagataataaataaagatcaggaccagtacatgctctttggtatacttctttttctccggtggaggaagaagattgttttttgcataattgttgatcattgttttggtcaggatcttgtcatcatcatgacgttttgaagcggcaagctgtgaatccatgaatgtggttacctgatccatatataaatcaatattcggaacatcttccggtttgacataatcaatctgctgcagggaatctaagattgaacgtaaaaattgttttgtatccatatttgtgtcacctctgatcacattatatagtattgaaaactagatgacaagatataaatgaagaaaaaataattcaatatgggttttattacatgaaatatttatgttatagtataagaacaagcaatgaaagaaaaggaaaatataaccatgagtatatatgatacgttgaatgaacagcagagagaagcggtatatcagacagaaggtccggtactgatcttagccggggctggctccggtaaaacacgtgtgctgacacaccgcactgcttatttaatcgaagaaaagggtgtcaatccttaccatatcatggcgatcacttttaccaacaaagcggcgggagagatgcgggagcgaattgataaaattgtcggatttggctcggagagcatctgggtatcgaccttccattcaagttgtgtgagaattttgcgccgtcatatcgaccggatcggatttgacaccaattttacgatttatgatgcggatgattcaaaatcactgatgaaggatatatgcaagcgtttagagattgataccaagatttataaagaaaaaagttttttggcagcgatttcatcggcaaaagatgaactgatcacaccgacagagctgatgcagcgtgcactgacatcttccgattatgcaaagcgtaaacaggcggaggtataccgggaatatcaggaggcgttacataagaataatgcgctggattttgatgatctgatcatgaagacggtggaacttttgcagtctgatacggaggtaaaaaattattatcaggaacgttttcattatattatggtggacgagtatcaggatacgaatacggcacagtttgagctgatccgtcttttggcaggcaaatatcagaatctttgtgtggtgggtgatgatgatcagtctatttataagttccgtggagcaaatatttataatatattaaattttgaaaaacattttccggatgcaaagacgatcaagttagagcagaattaccggtctacgcagaatattttaaatgctgcaaacagtgtgatcgcaaacaatgtcggcagaaagtcaaagacactctggactgcaaatgatgagggaaagaagattgactttgaacagtttaataccggctatgaggaagcagattatattgcgcgtgatattgcaggcggggtaagaaacggagattaccattatggggattatgctgttttgtaccggacgaatgcgcagtcgcgtctgtttgaggagcgttttattgtatcaaacattccatataagatcgttggcggtgtaaatttctatgcgagaaaagaagtgaaagatctgctcgcttatttaaagacgatcgacaatgcgcgcgatgatttggcggtgcgccgtattttaaatgttccgaaacgcggtatcggcgcaacaaccgtaaaccgtgtgtctgattatgcggagtcatacgatatcagtttttacgatgccttaaagcgtgcggacgagattccttcgattggaaaagcagcgtcaaaggtaaaaccgtttgtaaatctgatccaggtattccgcagtaagctggaatttatcagcatttccgatcttctccgggaagtgattgaggaaaccggatatgtcaaagagcttgaagcggaaggtacggatgaggcagaagcgaggatcgagaatatcgacgagctcttaagtaaagttgtgagttacgaggaaagcgaagaacatccgacactgagtggctttttagaagaagtagcactggtggcagacattgacagtctggaagatgacagcgattatgttgtattaatgactctgcacagcgcaaaaggacttgaattcccgaaagtgtatttagcaggtatggaggatggtctgtttccaagttatatgtcgatcacatcggatgattcgagtgagcagttagaggaagaacgccgtcttgcctatgtgggtatcacccgtgccatgaaagagctgacgatcacctgtgcaaagcagagaatgatccgtggggagacacagtacaataaagtttcccgttttgtcaaagagataccgctggagcttttagaaggaaaagcccccgttgtttcgcgaaaagaatcagattcttcgattgaaaatacatggaatgtgaaaccaaagcgcatgacgatgagacagcagccttccggacagagcatgcaggcgcgtgcatttgcctctgttcatacgaaagaagaaaagctgccgtatgatattgcagaccgtgttttacatacgcggtttggagaaggaacggtggttgccattgttgaaggtgggagagattatgaggttacagtccagtttgacacggtgggaattaaaaaaatgtttgcttcttttgcaaaattaaaaaagttataaaatcgtttaatttataaattttttataggcgaaatgggaaacatatgatataataaacatatgcaataagcagtgcggaattatttgttttctgaacaagtactgcaatatgggaataatatgtatcatatgactgtaagatgtcacagtctgaaaatagaaggaggggagccccatgaacaagatggatgatttaaaagatttagttaacatttcaaaattaaatgaactgctgaacaaaaaagaagcagaggaagagaagaaagcttccaaagttgtctgggtattcgcaattatcggaatcattgccgcagttgcagcagcagtttacggaatctatcgtttctttgcaccggactatttagaggatttcgaagacgacttcgaggatgattttgatgatgatttcttcgaggacgaagaagatgacgacaaagcagaagagccggcagaggacaaaacagaagagtaagaaatatctttaaggggctgcagtgttgcagccctttttaaattcataggaaaagagaaaggaactggttatgaaaaaagggcagatcgtagaaggaatcattgaacgggtggatttcccgaataaaggaattttaagagcggaagatggcacgcgtgtcattgtaaaaaatgcgatcatgggacagaaagtatcagcggcggtcaataaggtcagaaaaggaaaatgcgaaggacgactgcttgaaatattggaaaaatctgcactggagttgccggaacctggatgtgttcattatgggatctgtggtggctgtacattccagagccttccatatgaggaacagattaagatgaaagaaaagcaggtcaaagacctgatcgacgcagtcatcactgaagaaaataagggatatgagtttttaccaatcaaagcaagtccaagaccaaaagcataccgcaacaagatggagttttcatttggagatgaatataaggatggtccgttggcacttggaatgcacaaacgcggcagtttttatgatatcgtaaatgtaggagagtgccagatcgtagacgaagatttccgtcgcgtgcttaagatcacgttggaatattttaaggaaaaacagattccattttatcataaactccgtcacaccgggtacctccgtcattttcttgtgagaaaagcagcaaaaacaggagagattttagttgaccttgtgacaactacacagatggaggaacttagtggggaaaatgaaagtgcattattagaaggctgggtgaaaaaactttgtgaggaaaaatatgacggtgtgctaaaaggaatccttcatacaaaaaatgacagcgttgccgatacgatcaaaaatgaggggacagatattttatttggacaggacttcttttatgaggaactgcttggtctgaagtttaagatcacaccattttcctttttccagacaaattcccttggtgcagaagtactctatcagactgcacgtgaatttatcggggatgcgctcgacgatgaggcgaatcagacagtatttgacctgtattccggaaccggaacaatcgcacagatactttctccggttgcaaagaaagtgatcggtgtggagatcgtggaggaggctgttgtggctgcaagggagaatgcagctttaaacggacttaccaactgcgaatttatcgcgggagatgtattaaaagtgatcgatacgatcggggaaaaaccggattatatcgtacttgatccgccaagagatggaatccatccgaaagcactggagaaaatcatccgctataatgtgccgcagatggtctatatttcctgtaaaccgaccagcttagcaagagatcttgaagtgctgcaggcgagaggttatcaggtgaagaaagtgcagtgcgtggacatgttccctgcgacgggaaatattgaaaccgtctgtctgctgggtagatgaaaaggaagcaaggtaaaaagctgttgttggaacagaaaacaaacatcacaagttttttataaaaaagattaatgaaatccaacatttcctcacattaagtcacaaaccgaattaatatcccccttattttgaatttttctatagcaggatgtctactataataaagttatcaatcgattatttaaaataaggagatgatatcaattatggtagtgaatgatttaagatcagcgcttgaagtgttaagacagatggatggtcaactggtggagactgatattgaagtggacccggaagcggagcttgcaggggtgtacaggcatgtgggagcaggcggtacggtcatgcgtccgacgaaaattgacggaccggctatgatatttaacaatataaaaaatcataaggatgcgcgagtggtgatcggtctgcttgcaagcagagaacgtgttgcgagacttatgggctgcaagaaagaagaacttggaaagcttttgtgcagggcggctttaaacccgatcgagcccgtcgtctcagaggaaaaggcgccatgtcaggaagtgatacataaagtaacggatcctgattttgacttattcaaattattcccggcaccgacgaacactccaatggacgcaggaccatatatcacaatggggatgtgctatgcaacacatccggatactggatgctcggatgtgacgatccacaggatgtgcattcagtcaaaggatgaattatccatatttctacagccgggaagcagacatatcggtgtgatggcagaaagggcgacagaactcgggcagccgcttccgatttctatttcgatcggtgttgatccggcgatagaagttggttcctgctttgaaccgccaactacaccgcttgggtataacgaactttcgattgcgggtgccatcagaaagactccggtggtactggcaccatgtgtttccataaaagaaaatgcaatcgcaaatgctgaatatgtgattgaaggagaaatccagccgggaatcagagtggttgaggatcagaatacacatacgggatatgcgatgccggaattcccaggatataatgggctggcaagtcatgagtgctggcttataaaggtaaaggcggttacgcatagaaagaatccgatcatgcagacggtgatcggaccaagtgaagagcatgtgaatctggcgggaattccaacagaggccagtatttataatatgcttgagaaggcattgccggggaaggtgacgaatgtttatgcgcatcagtcaggcggaggaaaatatatggcagttcttcagtgcagaaagaccgtgcatacggatgaaggaaagcagagacaggcagcgctgctggcgtttagcgcgtttccagagttgaaacatgtgatcctcgtagatgaggacgtggatatttttgacacgcgcgatgttctgtgggcaatgaatacgcgctttcagggagatcgggatatcattacaattccaggggtaaggtgtcatccgcttgacccgagttctgatccggtttacagccagagtatttccgataagggaatcagctgcaagacgatttttgactgcacggtaccatttgaactgaaggataaatttgcacgggcaaaatttatggatattgatgaggaaaagtggaaggattttatttgatatgaaaaaaattctggtagggataagtggggcatccggagctccgatcgcgatcagactgttgaaacggctgagagagatggctgatgtcgagacacatctgatcatgacaaaaggggcagaacttaccattgtccaggaaacggattgtacagtagagcaggtaaaggcacttgcagatgtggtgtatgatgtgtattcacttggcgaatgtcctgcgtcagggagttttaaaatggacgcaatgatcattgttccatgttcaatgaaaacagctgcgggaattgcttccggttacagtgataatctgctcctgcgtgcagcagatgtgacgttgaaagaagcaagacagttagtacttgtggcaagagaatcgccccttagtccggttcatctcaggaatcttcatgagctgagttccatgggagtccgcgttgtaccgccaatgatcagtttttatcaaaaatatacgacgattgaagcgtggacggataattttgcggaacggttgttggaaatattgggattacataatacaatgcaatcctggagcggaatgtagagagagacgcatcaggataggtggtgtaaattgataaatttgattgaaaaacagattgtactgttagacaggatcgtacaggtatccgtctgcaggacggaatgtgggatacaggtgctgatcgcaggcggggacaggtcacatataggcgctgtgagcatcgtagatgaaaaatctaatttgatctcgcatgtttttgaaggacataaggatcatgtgatcagtgacaggtgggcagttaagttgtatgaacgttttttagttccggtggtggtatctgctgggattcactacgataaaattacgccggatgggataaagacagtgattgaagaaatagaaaaactgttagaagaggtaatggcgtacgaataaaaaaggcggaaaagatgaattcatcttttctgcttttttgtgggcatagaaaatttaccgggcgtatatgtcaggatttgaacaatttatcgttgcataaatttacaaataactgtgctgtttttgaaagaggcttgtcgcagcggtagcataatgaaagctgtgatgaaataacaggcgtgataggaacagcacaccatggagcaccggtttgttttggaccattttccggaagctgaagatgaacgttcatcagcagagcgacacagttttggttggttaccatgtctaaaatggaatcaattctgtggctggtaaaaacgatatctggaataaaacctgcattctggcatgcatccattgacatctggtacatcagggaaccttcttttataaaacagaaacgatcatttttaagttgctgcagagtaatagacgaagaagacgccagagggtggctgagtggaatcagtgcaaccagatgatcactcatgtaagggatcctcaaaatgtgatggtcattgagaaagtttttttcaaaagtaactttatcttcacggttaaagatcagctcacatttttcattttccagatatgtcattaaatttacaggatcatcttctgtgatccgtacggtagtttcggggtataatttctgaaattgtgcaagaaactgagtgatgtgatactgtggcatagaaggaatcgtaccgatggtgagaagaccattttcgatattaagcattctctggatagcagaaattccttcaaattcggaacgggtaacggattttgcgtaaggcagaaaaatttctccatagtttgtgagttctacccgtcttgtggtgcgtgtaaataaagccacaccgaggtcattttccagacttttgatatgttttgataacgtggactggttcatatagagccgttcagaggcttcccaaaagttttttgtttcagcaagaacaataaattcctttaaattctcagtattcatgcagctgttctcctttaagtctgtttctgacttaattctatcggaacccgaattgtttgtcaacgcagggcaaaatataatagagatatcaaaaaaatatatcttttgggaggtaaatatggataacagaaaaaaagtgccgcttaaaaataagctggcgtacggtattggaacgggtggaggaaatgtgttcagtcagatcgcagcggcatttcttctcaattactacacagacacagcactgataggtgcaggtgccattgctacaatgtttctggtgtgcagggtttttgatggtattacggatctgcttatgggtggcattgtggataagacatctacaaaactaggcaaagcaagaccatggctcattgcttcggcgccgctttcattcttgggaattgttcttttgatgaatgttccaatgggacttggagagaatggaaaacttgtatacgcttacattacatatattttcatgagctgtattgtatacactatttatggaatctccaatacagcccttctgccactcatgacacatgataaggacgattctacaatgcttgcaacattttctgctctgggaaataatatcataggtctgatcgcaggctccctgattacgccgcttgtattaaatcttgggtggaagacatcaagcatcattttaggttttgctgcgtgtgtccttattctgatttcaggattgctcaataaagaaatgggcaatgatgaggatacaaagaaaatggcaggcattccgatgagccagcagctcccggcaactttaaagaataaatatttctggttattattgctgctcggcgcattttcacttattatgaatgcaaatgcgattggagcacagatttactactgtaatatggttttaggaaaaccgatgtttatgtcagcccttatgacagcaggacagcttccaggtatttttattctgtttcttatgccggccgtttcaaagaaatggaataaaaagacgttcctgcttatgggagcagtactgatcattgtgggatttgtcattacaggtattgccggtggaaatacaacgcttatcgtgataggaaccgtgatccgctcacttggtgttggaccgatcctctcagcggtatttgcacttgtccaggatgtagtgcaatatggaaactggaaatatggtatccgttccgagggacttatttcatccgcacagtccatcggttctaaaattggtatcggtattggcagtgcactgacgggctggatccttgcatcggtaggatataacccggcggcggagccgactgcagcagtgatcaatgcagtaaaatttgactatacatggatgggggctatcctcggagttgtaattcttgttattgtattattacttgatgtagaaaaatatgctgatcagtataatttgtaaggaaagaggtatgggataatatgtacgatttaaaatttgatccggagaaatatgagataaaaacctgtgaacttcaaaacaggagtgttacttacagggcatttgaaaatatcgtttattgtgcaaagccggtaagcagtgtacagaaattaaatatttatgtgccggaagcgtattatcagggaaaaacgatcaatggatacgatttaaagacagcaccggtttttgctccgaatacagtaggaggatatatggaaggtcctgcaatggaggttgggatagatccgtttaatcataaacctaatacagcatttgaagcgctgctgcacggatatgtagtattgtgtgcggggatcaggggacgtaataccggtatgaattcccaggaattttttgtgggcggttccggaaaagagaataccgggaaagaggaaaagttgacaggacgtgcacctgctattattgttgatatgaaagctgcaatcagatatatgagatataatgcggacgtgatcccgggagatgtggaaaagatcattacaaatggaacatcggcaggaggtgcactttctgcactggctggggcttccggtaatgcgaaggagtatgagtcttatctaaaagcgatcggtgcggcagatgagagagatgatatctttgctgcaagctgttattgtccgatccataatcttgaaaatgcagatgctgcgtatgaatggctctttcagaaagaatccgtatttcatatgatgaaattcgagatgagtccggaaggtccgaaaatgatccctgttgcaggggcactggatgaggagcagagaaaattatccaaagagctgaaagcagagtttcctgactatgtaaacagcctgcatcttaaggatgataatgggaatgaacttactcttgataaagaaggtgaaggttcctttaaagattatgtaatgagttttgttcttgcatcagccacaaaagagagggcagatcttgattcacaaaacaagttaaaaggacttgctgttccaggaagtgagattgcagaacaaaattatatcacctataccggaaatgaggcaaccggtatagacgcggatgcgtatgtggcaaagattacccgaatgaagccgacaccggcatttgattcattgtccttaaacagcccggagaatgaggaatttggcgatgaaaatgtatttgcaagacattttaccagattttcggcagaacattctaaggttcatggagagatggcagacgcggataggatccgcctgctcaatcccacctggtttatcggaacctgtgatactacaaagaactggcggatcagacatggtgcatttgacagagatacttcgattgcaatccctgttatattagcttccatgctcaaaaataaacactataatgttgattttgccctgccatgggggctgccgcacagcggtgattatgatctggaagaattgtttgcatggatcgacggtctggaaaaataaaggtctgcaattctgttgccaattgattagaacatcggtataatcataggcagagaggacggaatatttatgaatttcatctacaaaacagccacccaacaggatatagacattttagttaccaccaggatcaaagttttaagagccgcaaacaaattagccgatcaggtggacatgtccgaagttgcggcacagtcgagagactattatgaaaaagccttaaaagacggcagccataccgcaatactggtctatgacaaagaccagatcatcggcgcgggcggtatcagttatttcagggtcatgccgacctatcacaacccgaccggaaggaaagcttatattatgaatatgtatacaaatccggcataccggcgaaaagggattgcataccagacgctgaatttactggtggcggatgcaaagaacaaaggaattgatgcgatttctttggaggcgaccgagatgggacgcccgctgtatgaaaaattcgggtttaccgggatgaatgatgaaatggaactgaaaaaatcagtttaagatttgtttataaaagacaccttttgtatttacatttagacgttatcatgatgtaatgagtgaaagtaatgagacatgcttacaggaatgataaataacaaatgtagaacaaaaggtgttttttatgacgataaaacagaggattttccggacaaattcacttatggtactgttttcccttgtaatcctgcttttgatcggttgaagtatgataagtatttttaaagaccggtttttagggtggtatagtgataattctaaaatatcagaaaagtatgtggatgcgtatcagaagatagaaaatatggatttttctgcaggggactgggagcagtacgctaaggcggtgcagccatatgactttcatctgatcgtccgggatgaaaatggaaaagagctttaagactggcggtaagcagtttttccgtgctgtttcctgctggatgtagtatttttatcagcttttcccaaacgttcctcaggcatatttttgcgcagaaaatcataagcctcattgatctcctgtgcagtaaaatcataggttctggtagaaaatgcttccgtgtcaggatgcacccggtgcatcagctgtcggtatttctttttgatatccgtaagatctgttccaggggtgattcccaggattttgtacgccattgcttttgtcataaatcgagtatatcataaaagagaaaaaggttgtgggaaaaatttagacatattaaaaaccaccttttgcccctaaatcttcatggaaaatcaggaggaatacacatgagaatcataatcgtaagacatggcgatccaaattacgaactggacacattgacaaaaaccggatggagggaggcagaacttgcagcggaatacctggcaaaactgcagataaaggcattttatgtatcaccattgggacgggcacaggataccgctggatgcaccttaaaaaaaatgaaccggacggcagagacactagactggctccgtgagtttgaagcacacattgacaggccggatgtgaaaaatgaaaagtcgatctgctgggactggcttccacaggatatggaaaaggatctggatctttatgacagggagcgctggaataagacagacatcatgcgaaaaggaaatgtggaagaagcttaccggtgggtctgcgatggtctggatgcactactgaaaaagcatggttatgagcgggatgatatgtattaccgcgtgaatgagccaaatcatgacacgatcgttctgttctgtcatttcggggtagagtgtgtgatgttaagccatctgttaaatgtatctccaatggttttgtggcatgggctgtgtgcggcgccgagctcgatcaccagtatttatacggaagagcgcagaaaagggatcgcaggttttcgtgtgaatgaatttggcagcacggcgcatctgtatgtggcaggggaaaaaccatcctttgcagcgcggttttgtgagtgttatggggacggggacagacaggattaaaattttgaatagctattgacaaaaacttccccttgctttatcatccacttaacatatggaaatagtaggaaataaaacggggtgaggttttgtctattaagaaaattgcaaaggaagcgggagtttccacagcgacagtctcgcgggtgttgaacaatcccgggtataaatgttcttcggaggaattgcgggagcggatctggaagattgccagagaactcaattatatgccaaacgaagcagcgagaaatctaaaaaagggaattacggataccagtcagaaagtgtggtatcttgatgtgctgatgacaagaacgggcaatcttgagacagatccgtttttcagtgagctgctgcgtgtcattgagagtgagatccacaggcagggatgcatactgatgcatatttttcatcagccgttgttttcgaatgacagaaaatgccggacggaaaatattgataaggtcattgcgcagatggagccggatggggacatccgcagtgatggactgatcatcattggaaaatgtaatgacaatgtattgaaaaagttatcggcaaaataccggagcatcgtctccgtcaaccgcaatttaaaatgcctgaataaatataaaaaccgctattacgttccatccattatttccagtgacgatattgaggaggcacagtataccaaaccgatgctcaccacagtgcgccttccaaaggaagagatgggaaagtttgctctttatcttctgatcgaccgcctggacggcggacataagggaatcgtccggacggagttagaaggaaaactgatgatccggtagaactgtgcgttagtggagaatgcaaaccggatggaatattatatctgagagaaaacaggtcatgagcctgttttttttatgttacctaaaactatctgtgtagcgaaaaaatttacaataaatttaccagacatttaccataaggagattccagtaacaacaggagaaagataaaatagccattgaacaaacaaaaggaaaggtaaaaaggagccggataaaaaggtaagttaaggcttcaaaaggagaaaatccacagtgggatgtcgtgtggatcgattccatgcaggcaggtgtgcttgtataccgcaagatgtgtggagcgaggcagatgtaacaaaaacacagagaactctttctgtatggtttaaaaccgtcaggaggagttcttttttatttaaagcttgtaaacgtttgcaggaaaataaagataattgcaaaattacgaataaaaacatacataaaaaaacgaaacaaacagtggaaaaataaggaaaataccatctgccatgcaaacgattacacaatccgtcgtggaatcgcatacaaaactggtatataaatacatcaagcaagacgtcgaagcagaaaacaatcacacagcaaaaggaagagtcgagcagatgggaacgccgacagagatttataaaaatccgaagacaccgtttgtggcgcagtttatcggagaatcagcaattattacggattatgacagactgaaaggatttcatctgtatccgggatgcagcagggcaatcatacggccggaatttgtaaaggcggtcagatatggaacagaaaagagataccagagcctgtacgcggaaggtatcgtggaacagaaaagtagaggtcattgtataccgtctgtatgcggtggatgagaaagaagcgcatctgatacagaatgaaggattccaggaaaatgagatgttttatatataggaaaaaattctgtccggagtggcgggcattgtaaagataacgcaggttgtagtttttgttggaaaacagggaggatgaaagatgaagaaagaaaaaagagtcatacaggtaattataaaaagtggtctgatcacatgggttctgctgcttttgatctggcagaccggttcgttattttacagcgatgattttcttccgggaccggttaccacatttgcgggagcgggaaaactggtggcaagcggagagcttttccgggatattttaatcagtatgcagcgcgtgttaaaaggctggctgcttggagggaatcggatatctgatctacacatcaagactttattataagacagactggatctttatcggtatttttacactcggtatcattggttttttagcagacaggattttgcagtttgtgggaagaaaagcattgaaacggttttgtgtgagataaaaccttgacgtttcccgcaaattgcgctatagtactctctactttacaaaaaacagtgtagaaatggagagtactatgacattttatcaggaacttcagctcagttcgacaggttcaaaacagctcatcaaaaatacaacagacaaaaaagaaaagagacgtcatatcttaatctataactttaaggtctatctggtgatggtattctgtgtggcggttgtgaccttatacagtaaactgaccggatcggaaaacagtgtggtcggagtgaccgttcttttggcagtgctggtgctgcgccaggcagattttgggatcaaaaccacgcatggactgctatcaatcgccggtatttttggaatactgatcgcgggaccaaggcttagcaatatgctttcgcccatcccggcattctttgtaaacgtattctgtatcatgcttctgatgatcttaggatgtcacaatgtgatcatgtacaaccattctacgtttgtactcggttatctgctgttacagggatatgacgtgagcggacatgcgtatctgctgcgcgtggagggactgcttgctggaatggtgatctgtatggcgattttctataagaaccagaaaaacagaccataccggagaacttttttggatctgttccgggaatttgatctttcctctgccagaaaccgctggtatgtaaaactgactttcattgtttcctctgcgatgcttgtgatgtctcttctgggacttccaagagcgatgtgggcggggatagcctgtatgtcagtctgcctgccgtttaccggtgactgcatgggaagggcagaaaaaagaggtctttttaatatcgtgggaagccttgtttttgtggcattatatctgatccttccggaatccatgtatccgtatatcggcatgatcggaggaatcggagttggttattctgccggctatgcatggcagacggcgttcaatacgtttggggcgttgtcgatcgcggcaggattgtttggactgcagaatgcagtgattctgcgtatcggggcaaacatttttggaagtgtgtatactgtgatctgcaataaaggtctggaccggctggcacaggtggtggaacagcggaaaaaagtaactgcatagagggcactcacaaaaaataaaaatcaaagaatgaatcaaagaaaatccccgtatactggaacaagggcatccgtatacggggattttagtgtgctatgcaaaaaatcagtcagcttgctgccacggggcagatcctgcttcttctggggacacatctgtattttacatttcgtctgcggtttatccagcgtaagatcccatgtgggatcaggcttagtttttccgggaaaaataatacttcctactcggcacttgcgacagcgttggcggcgacgatcgggacgggaaatattatcggtatctccacggcgatcgcagtcggcggggcaggtgcggtgttctggtgctggatcaccggtgtgcttggaattgcaacctgttatggagaatgttttttgtccatgaaataccgcaaaacggaaaaagatggaaagaggatcggcggtccgatgtatgtgttggagagaggcatgcagcagaaaggacttgcggtcttattttctgtgtttacgatattagcgtcgcttgggatcggcagcagtgtgcaggcacattcgatcagtgcggcgataacggaacagataccggtatcgccgcatatcatcggcatggcagcgggggtgcttgcggggaaggtgatcatcggtggcagccggcagattggaaaagtatgtacctggctggttcctgtgatgagtgcattttatttaggcggatgtatttttatccttatgaaaaattatacggtgatcccggaggcagtaaaaatgatcgtgacctctgcgtttgtgccggaggctgccgcagggggtgtggttgggacaacggtgatggcggggttaagaaccgggatttccagagggctttttacaaatgaggcgggacttggctcaattccaatggcagctgcgacggcgcagcatgcctcaccgcgggatcaggctcttgtctccatgacagggcctttttgggatacggtcgtcatgtgtgcaatcacaggaattgcttcggtttcaagtatgattgcccatccggacaattatgtgggggtgccgggggagcggatgtgttttgccgtattccgggaactgccggtgtggggcgatgagatgctgtcggtttcattggtcttgtttgcgtttgcgacgatcatcggatggaatgtctatggcgagtgcgccgtgcggtatctgtttgggaaaaagggtgtccgcatttaccaggtcgtttatatgatatgcgtttatttcggcgcagtgattactctcgatgtggtgtggggcatttcggatttgtttaattttctgatggcagtgccaaatctgatctgtcttttgggactgcgccgggaaattgaaataaaagatacaaaaaagaaatattaatgtttacgatactagacaaaacagaagccgaaagattataataggcagtatggtgtgcagacagcacatgtaaatattaataaggaagaaagaggtaaccgtatgtacataatacagtttatcagaggattttgtatggcacttgcagacagtgtcccgggagtatccggtggaaccgtggcatttctgcttgggttttacgatcagtttatcgactcgatcgatgatctgatcaccggaaatatggaaaaaaagaaaacagcgtttttctttctgatcaagctcggtatcggctgggtaacaggaatggttcttgcgattctgatccttgcaaatgtttttgaatcccatatttatgcgatcagctcattatttatcggatttataatttttgcaattccgattgtagtccgtgaagaattggacacactaaaagggaaatatgcatattgcccgtttgtactggttggggcagccattgtgtgtgccatcacctattttaatccggttggcggcggaaacagtgtaaatctggaacatctgacagtcacaacaggaatttatgtattcatagcaggcgcagttgcaatctgcgcaatggtgcttcctggtatttccggttccacactgcttttaattatgggactttacctgccgatcgtgacggcgatcaaggatatcctgcatttaaacttaaaaagttttccgacagtattcgtattcggatgtggtgtgttagtcggtattttcagtattgtaaagctgatccgtaaggcattagagcgttttcgggcgcagatgatctttctgatcgtcggactgatgcttggttctatttatgctgtgatcatgggcccaacaacactggataccccacagcctgcaatgacgatccacaatttttccatcctgttctttattatcggtggggtagtgatctttggtttgcagcagatgaaaaaaattaaaaaataaacatttgagggcagtgtgaaaataagattttcacactcaagtttgtgcttacgcccaaacttgtcatgcgtaaagtgcagcgtaaaaatggagaatactatgaaaaagttactggtttatttaaaagactataaaaaggaaagtgtattaggtccgctttttaaactgctcgaggcaacctttgaactgatcgtgccgctggttatggcggcaatcattgatactggtgttgcgaccggggacaagtcctatattatgaaaatgtgtatggtgctggtactgcttgcagtgatcggtctgacctgctcgatcaccgcacagtatttcgcggcaaaggcggcagtcgggtttgcaacaaaactgcgccatgcgctgtttgcacacattgagagcctctcttttacagagatggatactgttggaacggcaacactgatcacgagaatgacaagtgatgtcaatcaggtgcagaacggcgtgaaccttgtgctgcgtctgtttctgcgttccccgtttatcgtgttcggcgcaatggtcatggcatttaccatcgatgtcaaagcggcactggtgtttgtcgttacgatcccgcttctttccataatcgtattcggtatcatgctgatcagtattccgctttataaaaaggtacagtcagcgctcgataaggtgcttgggatcacaagagaaaatttaacaggaagcagggtgatccgtgcttttaataaggaagatgatgaaaaagtacattttaatgaaaacaatgatcttctgacaagggcgcagatttatgtcggaaagatatcagcactaatgaatccgcttacctatgtgatcatcaacggtgcgatcgtggtgcttgtctggaccggtgcagtccgtgttgataacggatatatcacacagggtgaggtggttgcgctgatcaactatatgtcacagatcttagtggagttagtgaagcttgcaaacctgatcatcaatatcaataaatccattgcatgtggaaaccgtatccagtccatttttgagatgcagccatccatcacggacggatcaggccagaaagtggataaggtgcagacggataccgctgacagatcagaagaagcagagtatgccgtggaattttcacatgtaggattaacctatgcgggtgccggagacgaatctttaacggatattgattttaaggtaaaaaaaggcgagacgatcggtatcatcggaggaaccggttccggaaaatcttcggtagtcaacctgatcccgcggttttatgacgtgacgtccggttttattaaagtggacggaaaagacgtcaaagattatccgcttgaggagctgcgtggaaagattggtacggttttacagaaagccgtgttgttccatggaacgatccgcgagaacttaaaatggggaaacccggatgcgacagaagaagatctgaaccgtgccatcacagttgcgcaggcaaaagagtttatcgacaacaaagagggcagacttgattttgaaatcgaacagggcggaaaaaacctttccggcggacagcgccagcgtttaacgatcgcacgtgcagtcgtaaagaaaccggagatactcattttagacgacagtgcatccgcacttgattttgcaacggatgcagctcttcgaaaagccatccgcgaaatggaaggagagacgaccgtctttatcgtttcccagcgagctgcttcaatccagcatgcagaccgtatcgttgtgcttgatgatggaaagatcgtcggacttggaaccagcgaagagctgttagaaagctgtgaggtatatcaggaaatctacaactcacagtttaagaaacaggaaggaggtaagacggcatgaaaaaagtagtgacagaccagcagaagacaacagtaaaaaaagtgcttgattacatccggagatactggttttaccttggcttatcgatcgtgcttgcggcagttaccgtggcactgactctttatatcccgatcttaacaggacgtgcagtcgacctgatcatcacgaagggacaggttgattttgcaggaatccttgtgatcttagagcgtatggcagtggtgattttgctcacggcagccgcgcagtggatcatgaatgcatgcaacaataagattacttacaatgtgatccgtgatatccggaaagaagcgtttgagcggatcgaacatttaccgcttaagtatattgattcccattcttatggagaggtggtcagccgtgtcatcgcggatgttgatcagtttgcagatggtcttctgatgggatttacacagttttttaccggaatcgtgacaattttcggtacactgatctttatgctgacgatcagtgtgaatatcacggttgcggtcgtggtcatcacaccgttatcattgtttgttgcaagttttattgcaaaaaagacattttccatgttcaaactgcagtctgagacgcggggcgaacagaccgctttcatcgaagagatggttggaaaccagaaagtcgtgcaggcattttcacatgaggatgaggcgttagagcagttcgacgagatcaacggaagactgcagaaatattcactgcgcgcgatcttcttttcaagtatcacgaacccggcaacacgttttatcaacagccttgtctatgcgacagtcggtgtcgtcggtgcatttcttgccatcagaggaagcattacagtcggacagttatcgagtcttttaagttatgcgaaccagtatacgaagccgtttaacgagatctccggtgtcatcaccgagctgcagaatgcacttgcctgtgctgcccgagtgtttgaactgatcgaggagccggtcgagaagccggatgcagagagtgcgaaagtgttagagaaagcggacggaagcgtagaactgtcccatgtatatttctcttatacgccggaacagaagctgatcgaggatttcaacctttccgtacagccgggacagcgcgtggcaatcgtagggcctacgggctgcggtaagacgacactcatcaatcttctgatgcgtttttatgatgtgaacagtggagagatccgtgtcagcggaacaccgatcgatgaaatgaccagaaagagcctcagaagcaattatggtatggtattgcaggaaacgtggttaaggagtggaacgatccgtgaaaatatcacgatgggaaaaccggatgccacggaggaagagatcatcgcagcggcaaaagcatcccatgctcacagctttatcaagcgtctgccaaaaggatatgataccgtgatctcggaggatggcggaagtctttcgcagggacagaaacagctcctttgtatcacgagagtcatgctgtgtctgccgccgatgctgatcttagatgaggcgacatcctcgattgatacgagaaccgagatcaagattcaggaagcatttgcgcgtatgatgaaaggacgtaccagtttcatcgttgcacatcgtctctccacgatccgagaagcagatatcattcttgtcatgcgggatggaaatattgtggaacagggaaaacatgaggaactgttagagaaaaatggattttatgcaaaactgtataacagccagtttgcaaaataaaatgtaagaaaaataagaacagccgtattttgaggtgacctgtgatcgtcagataatgaagcagcggtcagaatgcctcaaagtccggctgtttttatgaagtttatttgaaggtgtttctaagatcagtagatcatgcggtttccgctgatacattctgtggtggaagtttctatgtaatggagagcaccgtctacgtcccttgcacggacgaaattataaatggataaggcactctggtataattcctcgatgctgtattttattgcatagcgcacccacaggctgcaaacaaggtcgcggaaagaggtaaaaaacagcggcagaagcatatttccactgataaaactcagttcgtggctgaattcaaagatcgatgcagcggcatcctccggggtggaggaattttttaatttgtccagataaaaggtaagtcccccgatttcagcgtcacttgctttttcaatcgtaaggcgggctgcaaggttcataaaaagaatacgcacttcgaggatggaacggatctcatcactgcttaaagaaccgccattatatttcataatggaaactaaggtgtccatagttccatttctgcggtaatcttccacgaacgtaccgatccgtggttttaccacgacaaaccccttcttttcaagttcggcaataccggagttgacgacggcacgtgaaacctgcatggatgaggcaagttcacgttcggatgggagtttcgtgccaatcggaagtctgccggaaatgatcatattttcaagttcggatataaataactctttgagtgatggtgcatttaatttttgaaattccataaaatttatacctctattgtgtcaaaaatatttgtggtatggtcacataccacaaataattttagggtttcccggaaaaaaaatcaagaaaatgttgttgaaagtgttcaaaaaagcatacaaaaaatgagtgataatttttgacaatttatgacaaaatgcatataatagaactatatcagaaagaagagagagaggattgccgatgaggtctttacagtctaaatttctggctttgacggtaggatgtgtacttctttcagcgctggcacttggatatgttggttttctatatacgcataaacttgtaaatgaggattccgcgcagttcatgaatctgttttgcgaggataaggcagaggagatcaatgcaacgctgacaagtattgaacagtccgtgaatatgattcaggattatacaatagaacagtatagcgaacttggaaaaaacgggatggacaaagacaataccgatgtgctggtaaagaaagtgcaggaggttgccttacatactgtgaaaaatacagaaggatcacgcggagtctatatgagagtgaatccggaacttgctggtccccagacaggttttttctggtacaaggatgaaaatggcgaagttactgaagattcccttgtcgatttttcaaaatatgcacaggatgataaggagcatgtcaactggtattatgaggcactcgaaaaagaagaggcgttctggatggagccgtatgacaataagaataaaaatgactggattatttcttatgtggtgccgatatacaggaatgaagactttatcggtgttctgggcatggatattgatatggcactgctgaaagaaaaggtggattctgtacagatttatgagagcggttatgctttccttgcaggagcagattatgtaatttattatcaccgtgattatccggaaggacttgatgaagaaaatacacatggaaagatcagaaaggtcttaaatttactgtacaaaaaaggaacacaggataatcttgtcggttataatctggatggcataaagaagaaaatgaccgccagacagttagaaaacggtatgttttttgttgtcaccgcaccggcaaaggagatcaatgcgtcgagtaaccgtattatccgattgtttttggtttcaacgctgtctatcatctttatatcggttttgatcacaatccatgttaccagggaaatgacgcgtccgctcaaagaacttacggaagctgcacagaaggttgccggtggtaatcttgaggtcaatatcgactgtgaatccaaagatgaggttggtgtacttgcagacagcgtgcaacagatggtaaatcacctgcggcattacattgactatgtgaatgagcaggcgtatacggatgccctgacaggcgttgccaataaagctgcatataaagagtatgtggataagttagataaacgtgcggctgatgagaagatcaaatatgcagttgttgtcatggatatcaataaccttaaaaagatcaatgacaattttggacatgaattcggtgacatgctgatcagggatgcaagcagactgatacaaaagggatttaaagaccatatcgtataccgcatcggaggagacgaatttgtgatcatcatcgaacaggccgaaaaggcaatatgtgatgagttgctgagaaattttgatgatggcattgtggttttcaataaaaacaatacaaagtatgaacagaaaatacagattgcgcggggaatcgcattttatgagccggactgcatagattcttttgcatccgtattccgtgaagcagatcatgcaatgtatgagaataaggttatgcagaaatcaatgcagactgcgccgcctgctgcgggacagtcttaggtaataaaaacagatggaggataaaaaaatggacgatgataaaaagatggcatggaaaaaactgctaagcgtttttggtgtgtttttcctgattatggcagtatggcagattgttgtacttgagctgttgaaaaatggagtgatcggcacaatggttgcgatgatactgatctgtgctgcaacagtaatcattttcgggttagtgtttgcattaatcaggacacttttggatgttttcagacagcttatgggcgaaggcacagaggcaggaggttccggtggtgttgcagagaaggcaaataaacttgcggagaaagatggtgagatcggacagcttgtgcgtacatttcaggagtcgattacttcattttcacaggttgtacttggcattaaaaaggcgacgaaggagcttggtgaggtttcggaggatttcaaacatatctttaagagtatgacaacttctctggatcagaccgagcaggcagttaccaccattaccgataatacaatatcccaggcagatcataccgttgatatgaaagagaagatcaacgctatcagcagaacgattgatgagattgctgaaaatgtttcgatgttagcacagagtgcagagcatatgaaagagagcaacaaagcagcagaagcaatcatggaggaacttgtaaatatcagcaaagagagcggcattgcgattgaaaatgtaagacagcagacagatctgaccaaccagtcagcgcaggagatccgtacggcaacagagatcatagccggaatttctaatcagacaaaccttcttgcattgaatgctagcattgaggctgcaagagcaggggaaaatggaagaggatttgctgttgttgcggaagagatccgtacgttagcagatcagtcaagagaatcaacagagcagatcaaccagattgtcaatacattgattgacaattcaaatatcagtgtagagatcacgcagaaggtatcagaagcgtttgtaaaacagaatgaaaagattcatgatacagaagagattttccgttcactgaatgaggaaatcaagaatacaagcgatgcggtagatggaatcagtgaagaagtaagtgcgttagatgatcataagactgtgatcgagagtggaatcacatctctgacagagtttgcggagcagaatgctgacagcgccaaagtaacgaccgagaatatggaagaattccagcagatcgttgaccagtgcaatcaggcgacagagcggattgtgacagtatcagatgagctggtaggttacctcggaaaagtaaacgcaaatgtaaaagataaaataggtggacgtaattaaaaaataaatcggaaatggagaaaagagtaccgcatgagcaattgtgcggtatttttcaatactatgagaacagaacagaaaacatcagtaaaaaacagcataggaagacttgtctttgtcggaatcagtgtcttgcttcaggtgatatggatcatcaaccttttcttatggctgaaccgttattcagcggcaatttcccttttttccacgctgatcgcagtctcagttgtctttgcaatatacggaacgcatggaaatatggcatttaaagtgccatggatgcttctgattgcagcttttccgatttttggattgtgtgtgtttctgttattcgggcgttcgaatctgacgaggagcatgaaaaaacgttatgaattgatcgatgaggaactttttccttttttaaacggtgatgatgaggtcataaaagaactgcaggaaaaagatttgtcgattgcaaatcagtcggattatatctggaaatacgggcattatccggtatatcataacacggatgtagcattttatgcggatgcgtcacaggggctggaggcacagcttgcagaactgaaaaaagcagaacattttatttttatggagtaccatgcaatcgagcaggcagaatcgtttgagcggattttaaacgttttgaaagacagaactgcacatggtgtggaggtacgtattttttatgatgatgtcggaagtatcggttttatcaatcatgatttccgtaaacgcatggaagaaaatgacattgcatgccgtgtattcaatccgattattccggtattgtccgtatttatgaataaccgggatcacaggaagatcacggttatcgatggaaaggtgggatttacagggggatataaccttgcaaatgagtattttaacattacccacccgtacggacactggaaggataccggtatccgcttagagggggatgcggtaaaaagccttactgtcatgtttcttgaaatgtggaatgccgtgaaaaaaacagatcaggattatcagaagtatctgccagagacagattatcaggcgaaacaggatggttttatccagccgtatgcggacagtccgttagatgacgagcacgtcggagagagtgtttatatgaatctcattgcacatgcaaaaaaggagatttatttcacaaccccgtatctgatcatcacagatgagatgaaccgggcactgggacttgcagcaaaacgcggggtggatgtgcggatcgtcacaccgggaatcccggataaaaaactgatctacaaagtgacacgttcttattatgcaggactggtgcgacagggggtgcgtatttatgaatacacacctggatttattcatgcaaaacagtgtgtctgcgacggggaagcggcaacctgtggcacgatcaatatggattatcgcagtttgtatcttcattttgaaaatggggcttttttgtacaactgtgatgcggtgaaggaaatgcggaaggattttgaacatatttttgccgagagtacggaagtgacagaaaaatataagagcgggcgatccgctgttttgcgtggaacccagtgccttctgcggttgtttgcacctttgatgtaaaaaacgcactttctattattcatgacaatagaatgttcgcagagtgtgcattctattgtatgaaatcttcacagaagtttaaataaatttttggtaaaagtatggtaaaatagtaattagaaggtaaccggtcaggagaagccgttacaaaataatgtttctaaggagaaagtcaaatggagtacatggatattgaaacagtcaaggaactggatcatgtttttggggacattgaggagttacagaagtttcgctgtctgatgatgcagtacgaatgtgcgatgttagaggtaaagacaaagctggatgtattaaatacagagctgtcggtccagaacagcagaaacccgatcgagtcgataaaatgcaggatcaaggaaccggacagtatcatgaagaaaatgaagcgtcaggagatcccgttttcggtggacaacattgaaaaaaatttaaatgatatcgcaggtgtccgcgttatctgctcttttccggatgatatttatacattagcggattatctggaaaagcaggatgacatcaaactcatcaagaaaaaagattacatcagccatccgaagccgaatggctaccgcagccttcatttgattcttgaagtgccgatttttctgaccaacgagaaaaagatgatgcgcgtggaagtgcagttccgtaccattgcaatggatttctgggcgagcttggagcacaagttaaaatacaaaaaagatatagacaatgcacaggtcatttcacaggatctctgcttctgtgcggagctgatctcacagttagacggcaggatgcagcagatcagggagcggctggaggagaagaaagatgatacacaatccaatattaccggggtttgattcagaccccggatgatgagaaagtcgatttaaagaaactgccggtgcaaaggaaatccaggtgctatggagtgagccggtttaaacagatcagtcctgaaactccctgtaatgtttcaaaaacaaatccgcaagatttccctgaagcgttaccccaagatcggtcagggtagcggagagtgcttctaaagcaggaaccatatgttctaatcttgcattttcgcccatgtgtccgatacggatcacttttccggacaattcatcaaaggagccggcaagcataatgttatattttgtgcgcatctcgtctaagatggattttgcatcggtacattccgggatatcaaaaaccgttacggtgtttgagtaaccgctctgcagatgaagttttaatcctgcttctttgacggctgccctggtggcggaaccgatccttgcatgacgctcatacagggttttatcgccggcgatcaggttaaatgcagcgcgcagaccgtagatatcgctgatcggcatggtgtaaggaaaccatttcttctcatagtaaccgtcgaaagccatcagatttgcatagaaagatgcaatcggggttttgcggtttttcattttttcttttgcatcatcactcaccacaacaaaagtaagaccaggaggtgcagagactgctttctgggaaccgccgcagagaagatcgatctgaaagtcatcgacgcagactctctcgccaaacataccggaaacagagtcaacgatcgttaaaatgccatactgtttgagcagcggacagattctgctgatatcatttaacatcccgctcggtgtgtcacagtggacaacggtggcgtaagcgtagtcgtgatgatcttttaagtattccgcgagtgcgtccacatccaaagtgttctcgtaatcggcatggtaaagttccgggatgccgccgtacatgctgacaaagtcggcaaatcctttaccgtagataccgttatcgatgacaagtactttatcgcccggctctgtcagggaagcgcaggcagcttccagtcctaaaattccttccccgtctaagatcagcgtctcatttttcgtgccaagaaggctgctgatcagctcgcaggtctctttgtaaaaatcataaaattcttcatccagatcaggatttgtgcaggcaaaactgcgcgcacgccttactgtttccggcacctgtgtcggtccgggagtcatgatcttgtacataataatctccattcttatccgtttttcaatgaaaacaacgttttcatttgcatctcaagtttgtgcgcaagcacaaatcttgcgtgtgaaaaatctcatttttcacacgaatcctcttttctgaaaaataaattatttaaaaatgattttgtttgctgctttgcgaagcggctcgataacgatcagaaccacaacggctgcaacaccgatctgtaccagatttccaggaatggaagtaaacggtgcgatccagttcccataaataattccttctgcgatatagtagccgactactttgatcacgcaggcagcaacgattgcaagtgcgtcaaagccaagaccgtgatgcttttctgtaattgcgccgactacataacccatgatggctacaatcacaaaagtgaaaggtgcccatgcagtccagccggagagcagatcaaaaagtcccatgccaatgccgccggcgagtgcaccgctttttttgccaaataaaatcgcgcagatgaaaagtggaacgttgccaaggtggatcagtccgccgtttgcggtgatcggaagtctgacattgacgaatgcggtaaatacataggtcagtgcgatgaaaagtgccgtgatagtcagaaactgtacctgaccgattgaattttctgcttttgcagctgttgtagatgttgtgctcatattcttttctcctcatttgtttcgtatgaccgatttttaacagttatttgtttatgcctatcttaaacgcacactggtttattttaaaatgccagttaagtgaaaaatgagcagaccagtttatgtggactttttatgctctgcttcaatacaacataaaaaagagtgccggaaagccgacactcttttttaaatccattgtttacaatatcttaatctaacaaataaaaactggttctatttaaaaagaaaaaggtacatgtgaaactactgattgtgctggtagtaattattttactactgtaacgttggttgcctgaggtcctttagcgccttctactacttcgaattctacagtagcgccttcttccagggatttgaaaccatccatgttcagacctgagtagtgtacgaatacatcattgccctgctcgtcagagatgaatccgtatcctttttggttgttaaaccattttactgtacctttgttcattgaaaagtacctccaaaaaatattactggctgtatttacagctagttagagcatatcataacggttttgaaaagtaaaggaaaaaaacggatattttttaacctaatttctcaataacaatattgtggtttttgagaaaaatctcaaccagtctgtcccattcgtgctctaaggatttatcggtggaaaagatacgataggatacaccggtcgtgagcataaggtttccattctggaacttcagattcaaaaacatgccggtcacatcctgtggtgtaaaaggcgtctgcatactggcaagcgtgcgggataaattgtccggtgagagcagaaaaacaaacttaaaataagcaggtgtccgttttcccttgatcagatcaaagcagtgctggcgcactctgccgtagggcagaaacgcaaggccggataacccctgttcttctaattcttcactggaataaaagtccggtgtgaccgttccgtcaaaattccacacagcatctttctggatcgtggcttcttttaataagaaatgatcgaatgtatcagagcataaaagctgattcataaaatttttaagttccgggatattgagcgctaacatgcagtatacctctttcataagctgatggtgtggtgctggagtttaaaggtggattttaatttctgcaggtatcatgatccacctttaaactccaacatcacatccccattgtaccataaaacacctggaaacaacagagatttcgctttaaaaaataaaagcccctgttctgcctgtgaattccaggcaaagcaggggatatcaattttgggtatcaaattactgtttttttctgtataatcactcaaaaaggacaccttttattgtataattatgttatggaacaaaacatacgaaagaaggtgtcctgaatgaaaaattagcattgaagaaactgctaacttatatgaagagtgtatataaaatcccgcaaaaaatcaagtgtttaacggacgaaagaaaaagaaaatctattccattgtttaacattgtcatgccggtactgctttttctgatgctgcagtatgaaagtttccataccattttttcagcccctgaaagcatgtcgaaaagactgaaaaactgtatcagtggaaggattccaaaagttgatgcagtccgcgaccttctctccagaataaacccggatgaaatacgcagcatacatgaagaaatgattgatatcataaaacgtaaccgggtattccgggaaggaacgataggcggatatgttgtggcaggtctcgatggtgtggaattattcagcagtacaaaaaaatcctgtccgaactgtctgagccgaaaaaaacacacaggggaaaccgaatacttttaccggagtgtggtgtgcatgattataggtaaatcgccacacgtaattctggggcaggaaatgttaaaaccaagggatggttctgggaaagacgaaggagaactgacaggcggaaaaaggttgattgagcggctgaagaaacggcatggacattttgcggatgtgattgtggcggatgcgttatatctgaatgctccatttatcaacactctgaaggaaaatggtctggaaggggtgatacgcctgaaagacgaaagaagaatgatttttcaggatgcagagcgtctgttcaaacaggatgagggaaaaaaggcatctttctggaaagggaaaaagaagattgaagtatgggatctttctggttttaagatggaagggtgtccatataaactgcgtgtggtgcggtatcatgagcagtgggaagaaaatggaaaagaaacagagcgtttcatgtggcttgtaacgactctggaagcggcagactaccgagtcttatgggaaatgatgcaccgcaggtgggacattgaggagaatggtttccatcaattgaaaacgtattaccacgcaaagcactgttactgtcgagatgcggttgaaaccatatttaatctgataatcataggctttaatgtaagagagttatatttgtaccgaagaagccggaactttgcaggaagtggtataagccgaaagagcataaaccggattttttgcgatgatctgctaacagaaaaagtgaaacagattttatgtgaaaaaggcggatagaaaatcagcagaaaaaatatatagggaaaaagcagggggaattttgcgcgtattgactaggaacgaagggtaaccgcagatggaatgctgataactggattatttataaaaatgcatagataaaaaagttaaaagcgaaatccctgtggaaacaaaataaaggatgtaatctttctgattttatagtagaataggagtggttttaatcagtatgacagaaaagaggaaatacaatgaacgaacaaacagttttatttgatttattaaaagagggagtatctccggcacatgtggtaaaatcgtgtgaaaaacgtttaaaggatgccggatttgaaaagatagcttatgaaaaagaatggaatctaaaagcgggtggacgttattatgtggatcaccacgataccacattgttcgcatttacgattccggaagatgagatgaaaaaagaggaaaaacctgcagtgcgcattgcagcggcacatacggattttccgtgtctgcgcattaagccgtcctgtgatgtcgtgacaaaccgctatgcacaggtcaacatcgaggtatatggaggtgcgatcttaaatacctggttagacagaccgcttggtgtggcaggacgtgtggcagtgaggggcaatgatccgtttgtaccggaaatgaaatattttgcatccgaaaagaatctgctgacaatcccgaatcttgcgatccatatgaaccgcgaagtgaataagggcgtggagttaaataagcagatcgatatgatcccggttgcagggctgcttgcagaagaagagaagaatgccgattatttcttaagttttcttgcaaaggaactgtctgttgcaaaagaggatattttagactttgaactgtcggtgtactgcaaggagcagccggagtatgttggggtagcagatgactttatatcctctccgagactggataacctgacatcctgtgcagctttagtgtccggtattttagatgcggaaagaaaagacggtatcaatctaatcgccttatttgaccatgaggagatcggaagccgcagcaaacagggagcaggttctatcttacttcacgacatgctgcttcgcattttagcggaatgcggtgcgaaggagagtgcgcaggagctgctgtatcagagtatgctgttatcggtagacgttgcacatggactgcatccgaatcaggcaggcaaaatggacatcacaaataaaccggtgctcggaagcggcttctgtatcaaggaggcatgttcccagtcctacgcaacagactgtgaggcgattgcaatcatccagcagatctgtgatctgaagaagatcccgtatcagaaatttgtaaaccgttccgatatggcaggcggcggaacacttggctctatcgcatctgcgctgctgccggtaaaaacagtggatattggtattccgcttctggcaatgcattcagcaagagaattgatgggggcagcagatcaggaggcactgacagagcttgtaacggcatattttttactttaaggaggaattttgaaaagaagaaaaaggcatacactgcttaagtttataattcttgcagtgatagcgggcggagtggttcaatattccggagtgcttaaggatacaggtgtgtttccggaaaaaatcacaaaccagatcagtgtagaacagaaaaatgcgaaagcagaaacatattccagtacggcagaggaacagacggcaaagagtacagagataagcacggaaaatgaaacagcggataccgaagtgccgcatggatatgcttatgaaacgctgacggcggagcagaagactgtctatgacgaagtgtaccggatcattctggcacatgattcaaaggtaaaagtaagtacctgtgatgaaaaagttttagagaaggcatatcgttctgtgatagcagatcatgggggcattttctgggtatccggttataactacacacagtataccatgggaaaaaagattgtcagcatcgatttttccccaagttatacgatggagcgcacagagcgtgattcctatcagaggcggatcgacgcagtggtggattccatattaaaaaatgtggatccatcctggggagattatgaaaaggcaaaatatgtgtttgaatatctggcgggaaacgttggatatcaaatggggacggaacaaaatcagaatatcatcagtgtctttttaaataagaaaacagtctgtcagggatatgccaacgccacgcagtatctgctgacacttctggggattccggctgttgtggtgacaggaactgcggagggagacacacacgcatggaatcttgtccagcttgacggtgcatattattttatggatacgacatggggaaattcttcctataacaatggtgcgagcggtatggggacttttatcaattataattatttcggggtgactacggctgagatcagcaaaacgcatcaggcggacggtacactgcttttgccggaatgtacggcaacggcagataattattatgtaagagaaggaaaatatatcaccgagtgggagccggaagtgatcggacagatttatggcgctgcttatcgtaatggagctgtcacggaggagattcgtttttcggatacatctttatatgatcaggcaaaagcatatctgatcgatgaacagcatatccgcgattattgtgagggaattacaggattatcgtatattgaggacagagatcagaatgtactgatcctgaagttttcgtagaaaagatatcagataaaaaatatataaaatataatagaaacctctatacaaaacaaagtttttgtgctaatgttatgtagtaattgatactacatgtaatggaaaaaaataacatataaaaagtttttgaataacaaattgtcggactatggaggttataagatatgtacaagatcgtgattgacagttgtggagaactgccggaagatttaaaaaaggatggacattatcagaatgtatcgttagagttagaggtagatggatgctatatccgcgatgacgagacatttgaccagaaggattttcttcgcagggtaaaggaaagtgttaccggaccaaagtctgcatgcccgtctccggatgaatatatgaagtcctatgaaggggatgccgatcatgtatatgtggtaactttatccggcaagctttccggatcttataacagtgccgaacttggaaaaaatttatttgaggaggaacatccgggcgagaagaagatttatgtattcaattcccgttccgcttccgtcggtgagacactgatcggtatgaaagtgcaggagtgtgaagaggccggtatgagttttgaggaagttgttgcggcaacagagaaatatatcagttccatgaatacattttttgtacttgaaacattagagactctgcgaaaaaacggacgtctgacaaatcttaaggcatttattgcaaatacattaaatatcaagccggtaatgggttctacagaggaaggatcgatctgtcagcttggtcaggcgcgtggcatgaacaaagcgctggataagatgattcaggatgtgattgcaaagacaaaaaactgtgagaacagggtgcttgcaatttcacactgtaattgtccggagagagcaaaagcagtaaaggaaaaaattgaaaagatagcaaagttcaaaaaaatcattgttacggatacagcgggcgtcagcacaatgtatgcaaatgacggcggtgttattatcgcagtttaatacggcagaataagtgtcagttaccgatctgccggcgtatgaggagtgcagcatccgtcagggaaaggacagtatatgaaagaactgacatatgaggaagtattagatcagatcgaacatcagagacggtttggaaatcgtccgggggcagaggtatcagcgctgatgctggaaaagttaggcagaccacagcagaatatgagtgtgatccatatagcggggacgaacggaaaaggttccgtctctgcttttttgtgctcaattttaaaggaagcagggattcgtaccggaatgtttacctcaccgcacctggttgatttcagggagcggatctgtgtggacggacagatgatatcccgtgaagaagtgacaaaacttggaaacatgttgcttgaggaggactttgggacagtaccgacgatgtttgattattgtctggcaatggcactgctctattacagggacagacagtgtcaggctgccgtgatagagaccgggcttgggggaagattagattcaaccaatgcaatcggcgtgccggaggttacggtggtcacgaaaatcgggtatgaccatatggcggttttaggtgatacattagataaaattgcggcggagaaggcgggaattatcaaaaatggtacaaaactggtattagagagccaggaaaaagatgcaatggatgttttgctggaaacagcggaaaaagaagcagttactgagataaagattgcagatatgcatgacgtgaccgaatgccgctatgaaaatggcagacagtatttttcctatcagaaatacaaaaatcttgagatggcaatgcttggtgtccaccagtatgaaaatgcggctgctgcgatccttgccgcagaaatttttctgaaagacagaggaatttcagatgaaaaggcagaatactatatcagagaaggaatcaaaaagacaagatgggaaggacggatggagatcctaagccgggaaccgttttttatggtggatggtgcacataatggtaacggagtggcggcattagcggaaagtcttcgtactttgttcccgggagagaagtttcattttgtcatgggagttatggcagataaaaactatgaggaaatgatcgaggaattactgccgcttgcactggattttaagacggtgacggtagagtcagagagggcactggcggcacaggagctgtcggagaagatccgggcaaagggaatctgcgatgccggacttttacactcttttgacgaactgatgccgggacggctggatgtggcacacaaaacgatcgcatttgggtctttgtactttgtcggggagattgaaaaatatttccaagatgtaacaaaaatcacaaaaaatttacaaatttactaactttgcttaacaggtggttataaggcatttttttggctataataatcggtgttgaaaaatgatgtagattagaaagagccgataagatggtatttagcagttttgaatttttattccggtttttgccggtttttttactgatgtattatgtgacgccgcagaaatggaaaaatgcggtgttatttgcgggcagtattttattttatacggcaggtgaggcagaatatgtagtgcttttacttgcttctgtggtgatcaactatgtttttggcaggctgatgtaccgggatacttatgagggaagagggaaaaaacagctgattttgctgatcgtggcgctgtgttacgactttggcgttttattcctttttaagtatagcggtttcatggataagctgccgctcggtattagtttttatacgttccagattgcagcctatatcatcgatgtttaccggggaagggtgccggtggaaaaatcgtttatccggcttggaacgtatgtgacgatgtttccacagctgattgccggaccgatcatcaactattcggaggtccgtatggctttatgcagcagaaccgttactttcgaacagtttgaatccggattaaaaacactgatactgggacttggtgcaaaggtgatcgttgcagaccgtattggacttttgtggaataacatccaggcaatcggctttgaaagtatttcaacaccgttggcatggatgggagcgtttgcatattcgatcgaactttattttgatttttccggttattctctgatggcattgggactgggacggatgcttggatttgaatttccgaaaaactttaaacatccctatatttcaagatcggtatccgaattctggagaagatggcatattacgcttggacgctggttccgggaatatgtctatattccgcttggcggcaacaggaagggaaaagcacgtacgatatttaatttatttgtggtatggagtctgactgccgtctggcatggggcagagggacattttctgatctggggagcatcactgctcttactgcttgctttggaaaaagcatttttactgcagtttctgaaaaaaagcaaaatactttcccatgtatatctggtgcttgtagtaccgcttacctggatggcatttgcgattgcggatgtaggacagcttggtgtctattatgcaagaatgtttccatttttcggtgtgggagaaacggtcagacagatggattttttgcagtatctgaaagattacggtccactgtttctgatggggattgttttttccactccatacccgacagctttatataaggtatttgaaaaaaaatggctggggagtctggcggtgatcgtggtgttaggattaagtctttattatatggcagtttctacgaataacccgtttttgtactttaatttttaggactggtgaataagcgtgaaaaaaataatgaaatgcagggttgctgtctttttgatcattggctggggggtactttccctgatcggatatttaaaaaaagacgggatctataaaaattattccatcgatgtaaaaaaaactccgtattttgtattggtgttagacggaattcatgataaaatttatccttggagtaaagagttgccggatctgttgccggatggaacaaaaccacagaaccaggaaagtgtcattgcaagtacagaaatgacggatgaggaaaacgtggcagggcagacggaaacagtaatgcaggatacagaaacggcggctgcaaaaccaaagaaatttatacaggtggatgacagttattttgatgatgcagtttttattggagattcgagaacggtaggtctgcatgattatggtggactggatcattccgattttttcgcaactgttggtatgaatatttatgatctgtggaaagatgcattctgtgaggtcaacgggaaaaaggtgacattagaggaagccttgaaggcaaagcagtataaaaaggtatattttcagatcggtatcaatgagatgggacgtggaacactggacgggtttatgaatgagtatcagaatgcagtggagaaattcaaaacactgcagccggatgcggtcatttatgtgcaggcgatcatgcatgtgacccagaaaaaatctgattcagatccgatttttaataatccgggcattgatgcgagaaatcagcgcatacagcagcttgcggatggtgttcgtgtgttttatattgatgtcaatgaagtggtgtgcgatgatcagggtggattaaaacaggagcttacgtttgacaatctgcatctgtacgggtcgaaatacaacatctgggtagatttcttaaagaccaaaggaatcgggacagaatgatgaagttttgggaagactggaaagaaaaactgaaaaaatttttgaaagcggatgtgctggcagaatgcaggcagcaggtggatcatgagaacagagtcatgctctgtgtcttaaacagttccatggtgtgcctgtcatttatgctggcattttacatattatggagaaaacaggcagactattaccatgaacatatgtgtattttatatgcagcattgtttctgatcttactgtttgtttccttttattcgaaaagagattcaggtatccgtttgtctgttttgatcgcggtcgagtacgttgcaataggttcctgttttgccatgaatcatattatatttggtggacgggaaagcacaacggcatattatcttctggtgggacttgcattttgttttctggtgcgtcccatccagatgtatctgatgcaggcggggatcacctgcatactggcggtcagtatgcgcttgattcacaggctgaacaggatcaatatgaaggtgagctgcaatgtctggccgaccgcgtggaaacgccggaagaaaagaagcggttgtcagaagctatggaattgtcgaatatccgtgaacatttaaaatcacaggatgtgtacgctgcgttcgaaaaatggaaagtaccgtcagaaacagatccgctgtatgtatttaaatcaacagacaggtacactgcttttaatgctttccgatgttgaggacattgtgaaagaagaaaaagaaaaacaggagcagctggagaaagcactgaagatggcagaggcagccaatgaggcaaaaacgaaatttttagccggaatgagccatgagatacggacacctatgaatgcgatcatcggtttaaattccatgatacgctcatcgcttgatgacagggagcaggtgcttgattatacggaaaaactggattcagcatcccaatatcttttagcactgctaaatgatattcttgatatgtcgcgaatcgagagtggcagcatgaaacttgctatccgggcatttgagggagataagttctgggataatgtcaatatgttagcgaaggcacaggcagtcatggcaggtgtcggctattcttttgaaagaagaaagacaatctcggaagtgtatattggggattccacaaggttagaacagatcatggtaaatctgatcaacaatgcggtgaaatttacccccaaaggtggaaatgtcaacgtctctgttgcagagcaggaaacggatggaagagtacagctgaccgcagtcgtttccgataatggaattggtatcgcaaaagattttctgccaaaagtatttgaaatttttacacaggagcatgaagaaaatacccgtgtttatggagggagcggtctgggactgtccattgcgcgcaattatgcaaggatgatggatggtgacattacggtagagagtgcggaaggaaaaggcaccgtgtttaccgtgaccgcaaaacttgattttgaccgccggaaaaaggcgcggaaggaaagaacagagaatatcagttttgagggaaagcggattctgcttgttgaggatcatccgcttaatgtcatcgttgcaaagggacttttggaaaagaaacagtttgaggttgtcacagcggaaaatggcaagaaagcggtggaacttgtgacagatgccccggaatattattttgatgcgatattgatggatattcgcatgccggttttagacggaattgaggcagcaagacagatccgtgctttagacagagcagatgtcaaagaacttccaatcattgcaatgacagcaaacgcaggagatgaggacagaagacagacgaaagaagcagggatgagtgaacaccttgcaaaaccgatcgatccgaaacttttatatacgacgctgcaaaaatttattttaccgtaaaaaagttataaatgattccccgattacacatactacggaaaaagattgtgtgaaaggggaatttttttatgtcattaaaaattaagatcacagatgtgcatgcaagacagatattggattcaagaggaaatccgacggtggaggtcgaggtgactgccgagacagagacaaccggcaaaaagatcacggcgagagagtctgtcccttccggtgcaagtacgggaagatttgaggcaatcgaactgcgtgatggtgataaagattatttcggccttggtgtgcagaaggccgtggatcatgtaaacacaaaaatccgggaaatgctgcttgggatgaatgtgttagagcaggcaaaattagaccgcgcaatggtggaacttgacggaaccgataataagggaaaccttggggcaaatgcgatcctcggggtatcgcttgcctgtgcaaagacggctgcaaaggcactggatatgccattataccgctatcttggcggaaccaatgccaaaacgctcccggttccgatgatgaacgtgatcaacggcggtgtccacgcaaaaaatacgcttgattttcaggaatttatgatcatgccggtcggagcacgcggtttctcacaggctcttaaaatgggtgcagaagtatatcattttctgcgccagatcttaaacgaaaacggtatgagtacagcagtcggggatgagggcggttttgcaccggattttaagaatacgggagaagcgttttcttatctctcaaaagcggtggaaaaggcaggttaccgtgtcggggaggatatcgtttatgcgatggatgcggcggcgagtgaactgtatgacgaggcgcgcggtgtctatgtatttccgggagagtcaaagggaaatggggaagaacaggagatcgcaagaagttctgaagagatgatcgccatgtatgaggaactcgtgcagcagttcccgatcgtttctatcgaggacggattgttcgaagatgactgggaaggatggcagaaactgacaaagagacttggtgataaagtacagcttgtcggagatgatctgtttgtgaccaatcccaaacgtatccagtgcggaattaaacttggtgctgcaaatgcagtccttgtcaaagtaaaccagatcggaaccgtgacggagtcgttaaatgcgattgagatggcgaagtcagccggatatcatacggtcatttcccatcgctccggggagacggaggatgcatttatcgcagaccttgcagtggcggtcaatgccggacagatcaagacgggagcaccgtgccgcgcagagcgcaccagcaagtataaccagcttttacgcattgaggaggaactggcagaggatgcggtgtttgtgccggaagaaatcactgaaaagcagaaagctgaaaaaatgggttgaaaaaaggaaacgtctatgttacaatgattaaagttgtgagtttgtaacctaggagggaacgatcgtggcagttgtaaaaacaattttgactgtagtttttattataatcagtgtggcattgacagttatcatcttaatgcaggaaagtaaatccgcaggacttggagcaatcgcaggtgcagcagacacatattggggcaagaacaaaggacgttccatggaaggtatgttagtaaaactgaccagaatttttgttatcttgtttatcgtgattgcagcggtattaaatatgagtattttttaagatgaatggatggctgtcgcagatgcggcagtcatttttttgattcataggaaattacgtcctatgaatcaaaaagccctccgggcgggatcgcactgcgtcggagatggattatgtcgcagggtggcccgccgcaggcggtgaatcctgtggaacaggattctttgataacagaaatgcttgcgaagcgggcatttatcattcctaagaaaaaaggacggggtttatggagaaaacaattttagaagaacggaaaaagacaatttaccagtttatctgcgatgagttttatgtaccgatgaaagcaaaggagatggcagtcgttttatcagtaccgaaatcccagcgcagtgaactgcagggagtacttgacgcgcttgtgatggatggcaggatcgaggtgacttccaagggaaaatatatcaaatcagaaggaaaatacttaatcggtacatttacggcgcatgcaagaggttttggatttgtcagcatcgagggggaagaggaagatatcttcatcccggaatcacaggtgcatggtgcgtttcatatggatacggttcaggtggcggttacttctgagaatagtggaaaacgcagggaaggtacgattacaaaaattatatcccgcggtaccacacgaatcgtatgtacttatgaaaaaagtaagacgtttggatttgccgtgccggacaatcctaaattcggttcagatatttttattccgcaggagcgttcgaaaggagctgtcagcggacataaggtcgtggtcgagatcacggactacggcaaagagggaagaaaaccggaagggaaagtggttgagatcattggtcatatcaatgatccggggacagacattatgtctatcgtaaaggcttacgacctgccggtagaattttcagaaaagatcatgcatcaggtggaaaatgtctcgaacgaagtcagcaccgcagatatggcaggacgcatggatttcagggactggcagacggtcacgatcgacggggaggatgcgaaggatcttgacgatgcgatcacactgacaaaagagggagataactataagcttggcgtgcacattgcggatgtttcaaactatgtgcaggagcacagcgcactggatgtggaggcattatcccgcggtacatctgtttatttagtcgaccgcgtgatcccgatgctgccgcataaattgtcaaatgggatctgttctttaaatgcaggcgaaaaccgtctgaccttaagctgtgtgatgacgatcgatacaaaaggaaatgtgatcgatcacacgattgcagagtccgtgatcaaagtagaccgccgcatgagttataccagtgtgaaaaaaatccttgaagatcatgatgaaaatgaaatcggagagtatgaagaactggttccgatgtttgaactgatgcaggaactggctgcgattctgcgcaaaaaacgtatgaagcgcggctcgatcgattttgattttccggagacgaagattgtgcttgatgacaagggaaaaccggtcgagattaagccttacgagcggaatgttgcaacgaagatcatcgaagatttcatgctgattgccaatgaaacggtagcgcaggattatttctggcaggaactgccgtttgtataccgtacacatgacaacccggatactgaaaaaatcaagaagttatcgacatttatcaataattttggttattctatccatatcggacaggacgaagtgcatccgaaagaactgcagaagctgctgcaaaagatcgatggaacgccggaggaagcactgatcagccggctgacactgcgttccatgaagcaggcaaagtatacgaccatgagtaccggtcattttggactggcaacaccttattactgtcattttacatcaccgatccgcagatacccggatctgcagatccatcgtattatcaaggacaatctgcgcggacggatgaatgcaaagaaaatagagcattatgacaagatcctgccggaagttgcgaaacattcgagcgagatggagcgccgcgcggatgaggctgagcgtgagactgacaagctgaaaaaggtggaatatatgtcagagcgtatcggtgaggtgtttgagggtgtgatctccggcgtgaccgaatggggattttatgtggaacttccgaatacggtggaggggctcgtacatgtgacaacacttgtagatgattatttccattataatgaaagtacttatgagctggttggcgaggtgacgaacatccgctataaactaggacagcgcgtacatgtcatggtgacaggaactgacaagatactgcgtacaatcgactttcgtgtggtgcgggagaatgaggaagaataaaaaatcatcttgcgttccccggcatttcggggtatactatacaggctggatattggataagaaaggaagggcatgatggcaaagacagaaaaaaaactgattgcgaacaacaaaaaagcctaccatgactttttcttagaggagcgttatgaagctggcattgagctgcatggcacggaagtaaaatccatgcgcatgggaaaatgcagtatcaaggaagcgtttatccgtatcgagaacggagaagtcattatttatggcatgcacgtcagtccctatgaaaagggaaatatcttcaaccgcgatccgctgcgtccgaagaagcttctgatgcataagtcagagatccgcaagctgatcggaaaaatcgcagaaaagggttatactttagtgccggttgaggtatactttaaaggaagtcttgtaaaagttgatattgcgcttgcaaaaggtaagaagcagtatgataagcgtcaggatattgcaaagaaggatatgcggcgtgaggcggagcgggatttcaaagtaaagaatctgtactaaagaaatttatggaaaaagaatggatgatgtggtctttttgattcacaggaaatgatatcttgtgtgtgaaagggctgcatctgaaatatatatttatgggcttgtaatggtttcgacagggatcatgaagctggagaagcgagtcgcacgggatgcgtcaaattccaaaattaaaattaaacgctgaagataatttagcatacgctgcctaatggcagcagtctgacctagagcactcacactttaggacccaggcttcgactatgtgagaaacgacgcaggcaaagctttgagcctgcgggcgtacgatgaagctactgaaaccggaactgtgcctacgcaggtctggcagagggaatgttaaaacataggatacgctcgtagaaggacaggggattggtttttggacacgggttcgactcccgtcaggtccactcgtaaagtgccgtatttacggcactttttaaatttcgtgttgcatttcgtgttgcataaacaagtcaaattgctttttcgattcaggacaatcttggtcgcatgtgatatgggagataatgggttatcctggtttacgggattgtcaatgataggaacgatcgccgtttacggactcaacattgtcaatgcatttcggggatttgataagcaggaaggggagaaactggcattttatgacatgctgatcaagctgatacatattccattttacatactggtatttgtattgggaatgctgctggctgccgtgatggtagtgccgatatttgtaatgctcacaccgtttttgatcctgatgctggcgataggagattttttcctgatgatcacgtcttccatgtacggaatcagtgctgccctgcggctgggaaaaacaagggagatatctaagacagcttccgtgatctattttatgttgcatttcttttttgtggcggatgtgatcagtgcgattctgctctaccggagtgcaaaaaaaggaaagaagcacatctcttaaagattctccgctattttgatgcttagatccatgtaaatgcagcggttttccggcagttttccggtcagcagataatctaccaaaagggagagggagcgtgcaccctgctcatccggctgttggcagattgtggcagagattacgccgtttcgtatcatttcacaggtcgatagaacagcatcaaatgtaatgatcttaagaggacgctgcagggatgcgtttaaaactgcacggcatccaccatagacgccggctgctgtaaaataaagtgcagacagatccgggtggcggtctaagaggtcagaaactacttcgtaactcttataatcatcatcgccattttccacgacatccacaatgcggatatttggatgctttgtatgaagatgggaggtaaaaccgctgatacgttcttcgtggcagagaacattgtgagagccggtcacgataccgacacttgcataatctccggaaaacagatgtaataaccctgcggcggtctgcccgcatttgtggtagtcgctgccgacataggcaatccgtttcgaatcaggcatgtcggtgttgatcgtaatgcaggggatgccgttttcccagagcaaatctatcttttcctgtatggcaggatcattgtagggagagaggatcagtccatggatctcttcttttagcagttcatcgatcgtctgaagctgactttgtaaatcaaaagaaatacggcgttcaatcacggtacatccgtaaatggacagttcttcaagtttttggcgaagaccgtccatgacctcatcaaaaaacggattttctgcgccgaaaagcaggacaccgatttttaattttttcttttgcgctgcaagcgcaataccagccttgtttggctgatagtctaaaagctttgcaatttctaaaactttccgttctgtctcggcgttgacaatgccgcggtgatttaacacacggtccacagtgccgcgtgaaacaccggaaagctctgcaatttccttcatggtagccatagaaaaacccctttttatttcaattgattcactttgatgccaacatcattcatacaaataaagataacataaaaaacaatacattgtcaacttgtgtgcatgtgcacatagatgggaacaggaaaaagaagtgttctacgaatcggatggaagtgcagatggctgaaataatgtgaaaaatgaacgtataagtaaatgtaaacaaaaataaatatgaaaaaatgtacaaaaagtatattgcaaaatggtcatcccggatgtatgataaataaaacgtgcacgagcacacaatgaagtgatttataaaaaggagagcgatatgttgtacataggaattgatcttggaacatcttccgtgaagctgcttttaatggatgcagccggaaatgtaaaaaatattgtatcaagagagtatcctctttatttcccgaatccgggctggtcggaacagaaaccggaagactggtacaaagagacgatgcaggggttaaaagaacttttggaaggttttccgaaagaagaagttgccggaatcagttttggcggtcagatgcatggactggtaattcttgatgacaaggatgaggtgataagaccggcgatactgtggaatgatggcaggacaacagaggagtgcgattacttaaataatgagatcggcaaagaaacattgtcagaatatacggcaaatatttcatttaccggttttaccgcaccaaagattctctgggtaaaaaacaaagagccggagaattttgcaaggatcaaaaagatcatgctgccaaaagattatcttgcatataagctgaccggagagcactgtacggatgtttcggatgcgtccggtatgctgcttttggatgtgaagaaccgatgctggtcgaaagaaatgtgtgaaatctgcggcattacgaccgacatgctgccgaagttatatgagagctatgaatgtgtcggtacggtcttaccggagattgcaaaagaactgggattatctgagaatgtgaaggtggcagccggtgcgggagataatgcagcagctgcagttgcaaccggaactgtcggagatggaaaatgcaacatttcacttggaacaagtggaacgatctttatttcttctgcaaaatttggtgtggataagcacaatgcactacatgcattctgtgatgcaaatggagcttatcatctgatgggatgtatgttatccgcagcgtcttgtaacaaatggtggatggatgagatcatcggaaccaaagattacaaaaaagagcaggaagcgatcacaaaacttggcgaaaaccatgtatactatctgccgtatctgatgggggagcgttccccgtacaataacccgaatgcgagggccacttttattggcatgacgatggatacgacaagagcggatatgacacaggcagtattagagggtgttgcatttgcacttcgcgattccttcgaagtggcaaaaacacttggtattccgatcgagcgcacaaagatctgcggaggcggggcaaagagtcctctctggaaaaagatcattgcaaatgtattaaatatcaaagtagatgtgcttgagacggaagagggaccatctttaggaggcgcaatgcttgcagccgttgcatgtggtgagtacaaaaatgtggaatctgcagcagccgcaatcgtaaaagtggtcgatacggtggagccggatcctgaacttgctgcaaaatatgaggcacgctaccagcagtttaaaaatatttatccggcatgcaaagatctgtttgacaagatcatctgacggacaggaaagggtattgttcctgactgttttgaatagtaacagtcggctaccagaaaaaatttgcttatgcaggaaagaaaacctgcagggcaaatgagatagaagataagaaaagagggaatatagcatgcagatttacgaagttacggatgcacgttttcgcaaatatggaaaagtaatccggaatattgatttttcagcattgacggaggcaatgaaaaagacgccggttccatccgatgtagtttacgagctgtcgatcgcagaattagaggcattgccggtggcaaaggagattgagaaagtcttttacggagaactgccgattcagatcggatactgtaatggacacaatgtgcttttaaatgcagtggaatatcaccgcagctcagagatcaatcttgcggcaaccgatgcggtcttaatattaggttcagaggcagatgtgaccgatgattttacctatgagacatcgaaaatggaagcattccgcatcccggcaggaacagccgtggaggtgtatgcgaccacactgcattatgcaccatgtcatgtggacgatgcaggattccaggtggcagtcattctgccgaagggcaccaattatccgttggatgaggcacacgccggcggggaggatgcacttcttacagcaaagaataaatggctcatcggtcatgccgagggcgggctgccggagggaagtcatatcggactcatcggcaaaaatttaaatgtcagagaataaatttttatagaaaaaatgaagtatgtacagaaaaaaagaaagcggaggaaaacaaaatgaataacattccagaagtaaaagttggtatcgtggcagtcagccgtgactgcttcccggagtcattatctgtaaacagaagagaggcattggtaaaggcctacacagataaatacggtgcagcagatatctatgagtgcccgatctgtatcgtggagagcgagatccacatggtacaggcattagaggacatcaagaaagcaggatgtaacgcactctgcgtatatcttggtaactttggaccggagatctccgagacactgcttgcaaaacatttcgagggaccgaagatgtttgttgcagcagcagaggaaacacaggacaacctgatccagggacgtggtgatgcatactgtggtatgttaaatgcaagctacaacttaaaattaagaaatgtacatgcatatattccggaatatccggtaggtgacgcagcagactgtgcagatatgatccatgatttcctgccgattgcaagaactgttattggattatccgagttaaagatcatttctttcggaccaagaccgttaaacttccttgcatgtaatgctccgatccagcagttatacaaccttggtgttgaaattgaggagaactctgagttagatttatttgaggcatttaacaaacatgcaggagatgtgcgtatcccggaagttgttgcagatatggaaaaagagcttggcaccggaaataaaaaaccggagattcttgcaaaacttgcacagtatgagctgacactgaccgactgggtagaggagcacagaggttaccgcaaatatgtagccatcgccggaaaatgctggccagcattccagacacagtttggatttgtaccatgctatgtaaacagccgtctgaccggacgcggaatcccggtttcctgtgaggttgatatctacggaacactgagtgagttcatcggaacctgcgtgagccaggatgcagtaactttacttgacatcaacaactctgtaccgaaagatatgtatgaagagtccatcaaaggaaaatttgattacaaacatactgatacattcatgggattccactgtggaaatacctgctctaagaaacttgcaagctgtgagatgaagtaccagatgatcatggcaagaagccttccggtcgaagtgacaaacggtactttagagggagacattgcaccgggcgatatcacattctaccgtctgcagtctacatccgacaataagatccgcgcatacgtggcacagggcgaagtacttccggtagcaacacgttccttcggttccatcggtgtatttgcgatccctgaaatgggaagattctaccgccatgtactgatcgagaaaaactatccgcatcacggagcggttgcattcggacattacggaaaagcactgtttgaagtattcaaatatcttggcgttccgatggaagatattaactacaatcagcctgcatccctgccatatccgacagagaatccatttgcataaaatgtacataaattaatatattacctgaaacccgcgcatctaaaacgtaacataccgttttggatgcgcgggtttttgcgtgaaagggttcgggtgtcaaaaggtggtttttattttttaacacccgaacccttccacataacccctgccatagaaactggaaatatctacttgtagaatcgcacatcatcctctgttacaatgcagatacgtcaaaatgaaacaaatatgtaatatttacttaacaaaaagtaaatatctgtaaatggaggatttctacataatgaaaaaaagaaacaagatcgtagcatttttactggcaggagtgattgcagcaggacatggcagcgtggtgtatgcggcagggtatggaagtgtggtgtatgaagatgtggcatgggatctgtgtgcgctgaatgaagaacgcatgaaactggaagtacaggaaaaaaatacagacaatgatgctgctgggaatgaccaagcagacatcgaagaacgtgaatcaccgcagagtacatctgaatatgctgatatcggtatcgcatccgtattaaattatgtgaatttacgcgcggaaccttccgtggaaagtgaggcactcggaaagctgtacaataacagtgcggcaacggtgttggaaacagttttggatgaggcaggagaggaatggtatctggtcagttcaggttcggtggaaaacgcttatgtgaaagcggaatatgtaaaggtcggggatgaggatctggcgcggggtgtcagcacacgatatgcgacggtaacgactacgacgttgtttgtgcgtaccgaaccgggaactgaggcatccgtgcttaccatgctgccggagggcgaggatgtggtcgtctatgatgcgctggatgagtacgggtggtaccgtgtgtcgacggaggaaggcttaggatatgtttcgggagattatgtgacggtccggacggagtttcgcgtggcagagtcgaaggaggaagagaaagagagattagagcgagaggaggcggagcgccaggcggcagcagccgcggcggaagcggcaagaaaagcacgcgaagaggaagagagaaaggcagcggaagcagcgagaaagatacaggaagaagcggcaaaagcaatggcacggcagcagacacaaaatgcgcaacaggcgcaacaaaaaaatgacaaagtacagggaagcagtcaggggcaaagcagcagttcattcggcagtaatacaacagcgaaaccgcaaacagtttccaatggacaggcagtcgtgaactatgcagctcagtttgtgggaaatccctatgtttatggtggcagcagcctgacaaacggagcggactgttccggatttgtgatgagcgtatatcaggcgtttggaatcagtctgccccattcttcaagtgcactgcgcagtgttggatatggtgtcagcttagacgcgatacagcctggagatatcgtatgttacagcggacatgtgggaatttatgcaggaaataatacgctgcttcatgcaagttctccaagtaccggcatcaagtacacgtcgcctgtcacctaccgcgaaattctggcaataagaaggattttctaatgatctatgggaaaatatggatgcgcaaccgattgaaaaaaattgtgaagaatttaaaaataaaggtaaaaaaaagggtaaatcatgtatttttgcacaagtataaatatgcattttttacaagagagaaaaatacatgttaaaaatttgtcataccgtgtcgaaataaaatccaatattgtcattttgctgataaatcaaggaatatcagggatttttcataaattgacaaatgaaaaaaaatgtgcaataatcagcaaactgataagaaaaaataatgttttttgttttcgatgtaggaaggaatgagtcgaatgattgaaagaaaaatcaaattatctgacacagaggaagtaaaggattttgtgaatgctgccggaaaatgtgattttgaaattgatgtatgttacagcagagcagtcattgatgcaaaatctttgcttggaatgctttatttaggtgtttgcaaggaacttacgatcaagtatggcgaaaaggatgcacgttttgaacaggttgttggaaaatatgcaatagcctgaagcagagatgctgcccatagatcatgatttatgggacgatgtataacagaagataaagggatagatgaaaagactgatttatatatctggaaaggtatgtggaatcagtcttttttgtgctataatccatatatgagcaaaaagattgaaaagaacgaaaaaggtgtcataaaaatatcggtccgtgatctggtcgaatttatcctgcgggagggcgatatcgacaaccgccatggacgcggtgcttctgcggaggcgatgcttgccgggggaagaatccacagaaagatccagaagcggatgggcagcaattaccatgcggaggttccactgaaaattgcaatcgaggaagacgagtaccagcttgtgatcgagggacgtgcggacgggattctgatcgagagcgcggaggaagagatcacatttgcggataattttaatcacatgacgatgccagaagactgcaaagtcacgatcgacgagattaagggcatgtacatgaaacttgatctgttagacgatgcggtcggtgtacaccgtgcacaggcgatgtgttatgcctatatctatgccctgcagcatgatcttgccactatttcagtgcagatgacgtactgtaatttagataccgaggatatccggtattttcattatgattacacgtttgaggaacttgcgatctggtttgagaagctgatcaccgagtacaaaaaatgggctgattttcagttcgcatggaaaaaactgcgtcaggcatccatcaaaccgctgcagtttccattttcctaccgggaagggcagaaggaattagcagccggtgtgtaccgcacgatcagcagaaagaagaatctttttatccaggcgccgaccggagcaggaaagacaatatcgaccgtgtttccggcggtcaaggcggttggggaggatttagcggacaagatcttttatctgacggcaaagacgatcacagggacggtggcgcgggaagcatttgaacttctgcgtaaaaacggatatcaggcaaaagtgcttacaatcacggcaaaagaaaagctgtgcctgtgtgaggagatggagtgcaatcctgtcaactgtccatacgcaaaagggcactacgacagggtcaacgatgcagttttttcgttgctgcaaaaggaagatatgatcacgagagaggtgatcttagaacaggcgaaggaatacaatgtctgtccgtttgaaatgtgtctggatacggcgacatgggtggatgatatcatctgtgattacaattatgtatttgacccgaatgtctatctgaaacgtttttttgcggatggtaccacaggagattacatttttctggtggatgaggcgcacaatctggtcgagcggagccgggagatgtacagtgccattatatataaggaagattttcttttggcaaagaagattttaaagaaatatggtcaggcaaaactgatgcgggaactggaaaaatgtaaccgcgtactgctctcctataagcgtgagtgtgagaaatatgtgatctatgaatcaattggaaattttgcgtttgagttaatgaacgtggcgtcggatctcgatgaatttttacagaaagcaccggagttcacggagcggaaagatttaagtgagttttatctgaatctgcgcaattttttgaatatttatgaactgctggatgaccactatgtcgtttatgcggaacacgagcaggatggacgctttaaactcaaattatactgtgtggatccgtcgaaaaacctgcaggagcgtatcaacaaagggaatgcaactattttcttttccgcgacgctgcttccggtgggctattataagagcctgctctcgactgaaacggataattatgcagtttacgcaaagacggcattccgggaagaacagaaattgctgctgctcggaaatgatgtgagcagcaagtataccagacgaagtgcaggggagtttgagcggatcgcttcctatgtaaaaaagacgacagatgcaaaaaaaggaaattatatggtgttttttccatcctacaaaatgatggagcaggtctgcgatgtctttctggaaaaatgccagtcagatccatcctgtgaaacggaaacgttgattcagcagcctgggatgaaagaagaagaaagagagtcttttttacaggcattttcggaagaattatcgggagagcggaaaggatcgctggctgcattttgtgtgatgggcggtattttcggggaagggatcgacctgaaaaatgaacagctgatcggtgcgattgtcgtcggcacgggactgccgcagatcagcaatgagcgggagatcctgatgggatattttgaaaaacggcttggtgccggatttgattatgcctaccggtatccgggaatgaacaaggtgttacaggcggcaggaagagtgatacggacggtggaggatgtcggagtcatagaacttttagatgagcgtttcctgcagagtgaataccgtgcgctgttcccaagagaatgggaaaggcagacggtatgcaggatagatacggtggaaaagtatttagaagaattctggaaccgttcttaagtctgtgtcagatcgtaggcagcagttttaagaattcctcggtggactgtgaaaccgggagcgtcgggttgatggctgcgaccatctgtctcgatggcagtttttcctttgtttttacgataaacagatctttggattcccggcttaaacagtaatccggtataaatgcgataccaagaccgatgcgcgcaaggtcgatcagaaggtcgttactgctaagttcgatctgcgggatcagctcaagctgatgctgtaaaaacaggttgtgcaggaactggctcgtcgtacttttgcggtcgagcatgaggattgggtactgtttcagttcctcaaacgggatctcctgctgtttcaggttaaaatatgccgggtttgcaatgaatacgtcggtaaaattgcagacggtcttctgaatgtaggagtgattcaggttcgagttcggaaagttggtcacgatcagatcgacttttccctgatcgaggagatccacgcagctaagggatgtcgcgttcgtcaccttgatcggcacgtttgggaactttttgtggaactgttttaaataaggtactaaaaagtaacggcagatggtgtcgcttgcaccgatgtgaagctgaccgagtccgagactgccggagtctaaaagctggctttcaccgcgctgaatcaggttcattgccggttcgatgtgttttaataatacttttccggcaggagtgagctgtacttttttcgtgctgcggatgaaaagcggctggtctaactttttctcaagcgttttgatcgactggctgaccgcggactgggaaataaaaagctgcttgcttgcctcggaaaaacttaaggatgttgccacataataaaacactttatataattcgtaattgatatccatgaagtcctctttctgcgggctggccgcatatcatttgaatgaagaatgttaataaaaataactatcatgattataagacgtgcttataaatctgtcaataaagactgataatggggatgcgtgaaagcattttccaatgaaagaaaatgattcaggagtaaaaataagaacatgtctgcaacaaagcagatataattcatgacaataaaatgctcgcagagtgtgcattctattatttatagaaatattaataaaattaataaataagattaaatatattaattatgcttattttataacctatgttatactttgaaaagacaaatggaaactgagaatggaggttaccgcatgagcagtgtaaaacgtgtatatgttgagaagaaaccggaatatgcagtccgggcaaaagaattgcagtctgaaatcagaagttatcttggaatcagtggtgtgacgaaggtgcgcgagctgatccgttatgatattgaaaatatttccggggaaacttataaaaaagccttagtaaccgttttttccgaaccgccggtagacgatatttatgaggaagagtttgatttaaacggagcaagaacattttccgtagagttcttaccgggacagtttgaccagagagcagattctgcagaacagtgcgtgaaattattaaatgaagaggaagagccgatcatccgcactgcagtgacttatgcgatcgagggaacgatcagtgacgaagaatttgcagcgatcaaaaaacactgcatcaacccggtcgattccagagagacaggcttagagaaacctgagactttagtgcagagtttcccggagccggaggatgttaagatctttgacggttttcgtgatacgccggaggctaagttaaaagagttatacgattcattgaatcttgcgatgacattcaaagactttttacatatccagaattattttaagaacgatgaaaaacgcgatccgtccatgacggagatccgtgtgttagatacctactggtctgatcactgccgtcataccacattttccacagaacttaaaaatgtggcatttgatgacggttattactgcgcgccgatgaaagagacttatgaggattacttaaatacccacaagaacctgtatgcaggacgcagtgataagtttgtatgtctgatggatcttgccctgatggcaatgaaacgtctgaaaaaagaaggaaagttacaggatcaggaagagtccgatgagatcaatgcatgttccatcgttgttccggtagaagtagacggaaagacagaggagtggctggttaatttcaaaaatgaaacacacaaccatccgaccgagatcgagccgtttggtggtgccgctacctgtcttggcggtgcgatccgtgacccgttgtcaggacgtacctatgtttaccaggcaatgcgtgtgaccggtgccgcagatccgacggttcctgtttccgagacgatctccggaaaacttccacagaaaaaactggtgagagaagctgcacacggatacagctcttacggtaaccagatcggtcttgcaaccggatacgtcaaagaagtttaccatccaaactatgtggcaaaacgtatggagatcggtgcggtcatgggtgctgctccaagacgtgccgtacagagactgacctctgatccgggtgacatcatcattttacttggaggaagaaccggacgtgacggtatcggtggtgccacaggttcttcaaaagcgcacaacacagagtccacagcagtctgcggtgccgaggtacagaaaggtaacccgccgacagaacgcaagatccagcgcctgttccgccgtgaggaagttgcccatatcatcaaaaaatgcaacgatttcggtgcgggcggtgtgtctgtagcaatcggtgagcttgcagacggacttcgcgtacagcttgacaaagtgccgaagaaatatgccggattagacggaacagaacttgcaatctcagaatcccaggagcgtatggcagttgtggtatctccttcggatgtcaagaccttcttaggctacgcagcggaggaaaacttagaggcagtggaagttgccgttgtaacggaggagccgagacttgttttagagtggagaggcaaagagatcgtaaatatctcccgtgccttcttagacaccaacggtgcgcatcaggagaccaacgttgcagtggatatgccggtaccggaggataattacttaaataagatctctacaccaaaagttgcagatgcggttgcgaaaaacgatatgaaggcagcatggcttgcagagctggctgatttgaatgtctgctcccagaaaggtcttgtggagatgtttgacggttccatcggtgcaggaagtgtttacatgccattcggtggaaaatatcagctcacagaaacacagtccatggtggcaaaacttccggttgcacatggaaaatgtgataccgtaaccatgatggcatatggttttgatccgtatttagcaagctggagtccgtaccacggtgcgatctatgcggtattagagtccttatcaagaatcgtgaccgcaggtggtgattataaaaagatccgttttacattccaggaatacttccgcagaatgaacgaggatccgaagcgctggagccagccatttgcagcacttctcggagcttacaatgcacagatcggttttggacttccatctatcggtggaaaagattccatgtcaggaacgtttaatgatattgatgtaccgccgacactggtttcctttgcagtggatgtggcaaaagagcaggatatcatcacaccggagttaaaggcagcaggaaatgaactgttatactttacgatcgacaaagatgaatatgacgtgccggtttacgcacaggtcatgaaactttatgatgcggttcatgcattgatccagaaaggtgcgatcgtttccgcatatgcgcttgacggaaaaggtcttgcagcagcacttgcaaagatggcattcggtaacaaacttggcgtgacagtagataccgatgtgacaactgatacactgtttgctccgggctttggtaatatcgtggcagaagttccggcaggcaagactgcagaagtttacgaggcactgcacaatgcaggtttatctgcaaacgtaaagagagcaggtgctgtcaatgaggaagcagcatttatctgtggcgatatgaaacttgcgatcgatgaggcattgaacgcatggacaggcacattggagaaagtattcccgactcgtgcaaccgaagataaagaggaagtaaagacagatctttatcatgcagattctgtttatgtatgcaaacataaagtggcaagaccgaccgtatttattccggtattcccgggaactaactgcgagtacgacagtgcaaaagcgtttgagcgcgcaggtgcggatacgatcgtaaaagtatttaaaaacttaaatgctgaggacatccgtgagtccgtagatgaatttaccaaggcaatcgaccaggcacagatcatcatgttcccgggtggattctccgccggtgatgagccggaaggatctgcaaaattctttgcaaccgcattccgcaacgcaaagatgacagaggcagttatgaaactgttaaatgagagagacggtttagcccttggtatctgtaacggattccaggcactgatcaaattaggactggtaccttacggcgagatccgcccgcaggcagcagattccccgacactgacctacaacacgatcggacgccatatcagcaagatggtatacacaaaagttgtcaccgacaagtccccgtggttagcacaggcggaacttggaaaagtttactgcaacccggcatcccacggagagggacgctttgttgcaccgaaagaatggcttgataaactgtttgcaaacggtcaggttgcaacacagtacgtcaatgaggcaggtgttccgaccatggacgaagagtggaacgtcaatggttcctactgttccatcgagggtatcacaagcccggatggacgtgtgctcggcaagatggctcattccgagagacgtgacagaagcgtggcaatgaacatttacggagagcaggatcttaaaatctttgagtccggtgtagcatattttaaataagagacaatatatagaaaagggaagagatatttatctttctttgacaattttaaaagaccttccagaaaggaaaagaaaaatcctttctgggaggtctttttatccatgttattttatccggactctcgccattgcgttcccaggtaggacggtagtctttatcaccggttgtatatcccttggtcagtgtgcagaaagaaccgttgtctgccggacagccttcgcataaatcttcctgacaaaatacttgtggtcgttcgtaggttttcataaaaatacaccctccattcttgaatctatatgtccgcttctatcatactagtataaagaatatgggtacatggataaatgtgtcattttttattcaggtgtgtttttatatgattttctgcgtttttatagacaaaaatgaatttgccaccggtaatgtgctataattaaataatctagaaagtgaacggaggaaaacagagtgcgaaaaaatcaggaaaaacggcagtccaaaacactgttagatattctgagagaagaaaaaacagataagtatcaaggcggtatctatcataaaacacagatcgatttaacctataattcaaatcatatggaaggaagccgtctgacgcacgatcagacaagatatatttttgaaaccaataccatcggtgttgaaaatgaagttcttaacgtggatgacgtgattgaaactgcaaaccattttcggtgcattgatatgataattgatgatgcctgtatggtattgacagagaaattgttaaagctgctccatctgactttaaaaaatggaaccagtgattccagaaaagactggtttgctgttggagattataaaaagatgccaaatgaggtcgggggtatggagactacattaccggagcaggtatccggtaagataaaaaaattgctggcagaatataatgcgaaagaagaaaagtctttggaagatattttggattttcatgtgaagtttgaaagaattcatccgtttcaggatggcaacggacgtgtcggcagactgatcatgtttaaagagtgtctgaaatataatattgttccatttattatcgaagatgatttaaaaatgttctactatcgggggctgaaagaatgggacaatgaaaaaggatatctgacagatacctgtcttacggcacaggacagatataaagcgtatcttgattatttccgaattgattattgatcattttaagaaaacttacagaaaatgaaaatcctttcaaactgatcaaaagatagatacaatatgatcaggcagcagagaacgtcaaaaacgtgtaaagataattacacgataaacaggaaagtataggtaaaatatgagcagaatcatcagtattggaaagcaggattttgtatctttaagaaagaaccattatttttatattgataaaacagattttataaggcagtggtgggaaagtgaaaaataccgcatactgcagggaacatatcgggttatttttgtcagctttgcggatgtaaaacagaacaattacaaagatgctgttcaaaagataaaaaatattattgtggatgtttatagacaaaaccgctatctaaatgaacaggaatgttttacagagaatgagcatcggcagatatgaagatacagatggaaagtcttttaaacggaaagacgattgaagttaattttgatgaacagatcgtgttcagccatcttgcacaggatgaaagcgcggtatggagtcttctggtagcaggtggttatttaaaggttgaggatgtggatgtaatgaattattgtatgaataagattacgcttgcaacgtttagttattttgatgtcggaagtgaaggcgctggaaatcaggaaccggaaagattttatcatggatttgtgcttggactgatagcagaccagacagatatctatgaaatcaggtcaaaccgggaaagcggctttggcagatatgatgtcatgatggttccgaaagagcgggaaaaaacaaaaataccagcaattatattggagtttaaggtaaaaaataataaaaaagagcagacacttgaagaaaacagtacagtcagcactagtgcagatcaaagaaaaaaattatgatgccgaactgttggcacggggaataccaaaagagaagatcagacattatggatttgcatttgaagaaaaaaatgtgttgatcggatcgtgagaagatattaaagaaaatggaatattctctttccacccggtataaaacatgatacgatgagaaaaataaaaccaaacaaaacaaaaatggaggcgaacatgaaaaaatttataatactattgctttcaatttttcttgcaatgtcacttgctgcctgtggaaataaaacagacagcagggattcatcaggaaagacagagatcaaagatgccaaagagcttcttaccacagtctggaacagctacgaagaagacgagaaattcgccatcgcaggcggagatatgacggaagaaaatatgacagaggatgcgccggggacatttgggatcacggatgcggatgaattagaccgcatgcttggctttccggcggcggatgcggaaaagatcgataatgcggcttccatcatgcacatgatgaatgcgaacacatttacctgcggtgcctatcatctgaaaaatgcagatgatgtaaagagcgtagcggcagacctcaaggaaaatgtgatgggcagacagtggatgtgtggatttccggacaagctggttgtaatttcggtggatgattatctggtatctgtttttggaaatgaagaactggtaaacacgtttaaagacaaactcacgcagacttatgaaaacgcgaaagtcatcagtgaggacgggatcgtataaatgttattttcaagtatcacgtttttgatttattttcttccgtgtatggtgctggtttattttctggctccggggcggatgaaaaatacagtgcttcttttggggagtctgatcttttatggatggggagaaccgaaatacctgccggtgatggcagcagtcatcttagctggttatctgtctgcccgtctgatcggtacatgtcagaataaacggcagtcaaaaattcttttggctgccgctgttttattggaaatttttccgctcatctattgcaaatatgccgattttttcatacagaatctcaatgtgctgacagggcagaaaattccactgcttagcattgcaatgccgcttggcatcagtttttatacatttcaggtcatcagctatacggtagatgtataccggggagatgtcccggcacagaaaaatctgctcacgtttgctgcctatgttgcaatgtttccgcagctcgttgcagggccgatcgtgcgctattcggatatcagaagtcagcttgaaaaccgcactcacagcgtggaaaaatgtgcatatggaattcgaagatttgtgaccgggctgtcaaaaaagatactgatcgcaaatgtactcggggagctgatcggacagtttcaggcttccgaggaaaaatcggttttatttttctggatgtatgcggtagcgtttatgcttcagatttactttgatttttccgggtacagcgatatggcggtcggactgggagctgtttttggatttgattttccggaaaacttccgctatccttattgttctgcgagcattaccgaattctggcgcagatggcatatttcacttggcgcatggttccgggattatctttacatcccgctgggcggcagtcatgtaaaacctgtgcggtggatctttaatatttttcttgtgtggatggcaaccggattctggcatggggcggcatggaattttatcctgtggggactaatgtatgcggtgcttttactgattgaaaaagcatggctgttgccttatttaaaaaaacataagatcgtcggacacctgcatgtgctgttttttgtgctgatcgggtttgtactttttgatgtatcctccgtggcggatttttggaattgcatcgtatctatgtttggcgggggacagataaaaccggttacgacagagagtctgtattatctgaaaagttatgcagggatcatcctgactgcggtgatcggggcgacgccgcttcctgtgagattatatggaagattgcagaaaaagaaaggcttaaagcagacgcttgacattgcagaaattctcctgctggtaatgttactgcttctttgtgtggcatttctggtagatggttcattcaatccgtttttatatttcagattttgagggcaattatgggaacaaagcgaaaagacaggatcactgttggcgtgacggcactgatcctgtttggatttttaacaggaaatattgcgaaaagtgatgatacggtttctgtctcagagcgcagaaaacttgcacagtttccgaaaataaatgtggaaaacatgaaagatggtacttttatgagtggatttgagtcgtatgcaaaagaccagtttccgttacgggagcagtttcgtgcattaaagacagcgttttccatgtatgtgctggggcagaaagaccagcatagactttatatcaaagatggctatattgccaaaatggaatatccgcttcatgcggattcactgcagtatgccgtcacgcgttttggggaagtctatgatcgttacctttcggatacagacacagatatctatctggcgatcgtgccggacaaaagttattttctggcagatgaaaatggttatccgtccatggattatgatatgctgacggcgcagatgagagatgggacgaaatatgcacagtatattgacatatttggggatcttgaactttcggactattaccgcacagatgcacactggcggcaggaacagatcacggatgtggcacggcacctcgctggggcaatgggggtaaatccggcgtcagaatacgaaacaaaagaactggaaaatccattttacggtgtctattatggacagctcgcacttcatggacagcctgatacactgtattatctggataatgacgtgcttgaaaactgtatcgtgtatgattatgaaaaccgagcggaaaataagatttacgacatggaaaaaacaacggggaatgatatgtatgagatttttctgggaggatcgaaatccctgatatcgattgaaaatccgaatgcgaaaacagaccgggaactggtcatgttccgggattcctttggaagcagcatcgccccactcctggcagaagattatgcgaagatcacactggtggatatccggtatctgcccgtggagcggattggaaactatattgattttaaagatcaggatgtgctgtttttatatagtacgtcggtgttaaatcacagtgagacgttaaaatgacaggaggctggggcgcaaatagtgcattcacaatatatcggctggtgcaatttgccaattaataaacttgagtgcactatttgccccggcatcctaacagcagttccggtcagggaatcgggataaattccggtttcctgttcttaaataccgtataatgcgtaaagccggcttcttttaagatagaaggaactttttcaaaatcaaatgcgacatgctccggctgatgtgcgtccgcaccgatcgtgatgatctctccgccgagttcatgatagcgcttaatgatgtcctcggccgggttcggatggccgagtccgtatttgaaaccgccggtgttgatctcgattccttttcctttgataatgagagcctttaagatctcatcgatgatgtcggcatatttctgataggaataactggcatttttatttggaccgtatctcaccacgtagtcgatgtgaccatagacgtcaaaaccatcgaaaactgcgatattttccagaatggattcaaaatattcctgatagccttcctcctccgtgtgattttcccaataagccggataataaggatcaacgccgtgcatgacgtgtgaggaaccgatcacaaaatcaaacgggtattgtgacaggatgtcagcatgtatgcaggcaagatgcggctgtaacccaagttcaatgccgagtcgaaccggaagaacttccttatatttctcctgcattgcatccacggaagagacataattcggcagatccagcaaaaatgtctccggttcgtccggatagtcaatgtcaagatggtctgtaaaacagattccttttaaatttttttgttttgcagcagcgatcatatcttcctgcggtgtgtgactgtcgccggaaaactggctgtgcatatgcgtatcccataacatattaaatcctctttcctgtgccgggctggcacataatgtgaaatcttatttgcgcaattacgcatatcacaaatgctggtttgtgggtgatatgagtttccctgtgtagggtggttctggggagttacgattggcaaattgcatcaagccgggactgttttgttccgttgtccgaaaataagaaagtctaagtatgcctgattcaggttgaggcggagtgacgtgtgcgtcctaaatgtgccgtccatggcagcacaacactgtattgtgaacaggcatacaaagactttctaattttctcccaaagtcacaaaacgagtcctggcttgatgcgatttgccagccgcaaggttgtgaaccacccttagccgggaaactcattttacaaccttgggggtgcgtaaatttttgtgacattcatttcaaaaaggttgaaaaatctcgacgcaatctgttatatctatgcttttaaacatacatacttggaataataatctgcattattagtctgttaatttacgaaatgattaatgtaatgcaacatagcagatgaaacttcagacaagtcatcaggctgaatatcagtgatattgcacattaggattttaagcatatttccattcgtgcgaatatcaaaaattcacacccgcgcccccattttgagatgaaccgcccacccaaatggtgtttcataacctggaggctggcatcttgcgcaaagcctgagctgattttgtgactttgggagaaaattagaaaatcttagtgtgtctgtagatacacagtgatgttctgccacggatggcagaacaaggcttcacgagccacggatggctcgttgaacgccggtcacgtcactccgagaaaatctaactcagacacacttagacttttcttattttcgtacaatggaaccaaaattaactccggctttgcgcaagatgccactcacagacctgcgacacaccattgggacgggcgatttatttcataaacaaaccaacatttggtaagtagcttatgatatagtatagcctatcttataaaagaaaagaagacacctttgtatattttgtataaaattcatgaaaaaacgaccggaaaattgcatatagtgaaaaatttaacaaacacagaataaagtcgagaaaaaggcttgaactttcaaaagaaattggttaaaataaaggaagcttgggacgggcataagtcccatcaagttatcacatttacaaattctaggaggaattaaaaatggcagtaagagtagcaatcaatggttttggccgtattggtcgtcttgctttcagacagatgtttggagcagaaggatatgaagtagtagcaatcaacgatttaacaagtcctaaaatgttagcacacttgttaaaatatgattcatctcagggtaaatatgagcatgctgatgaagtttccagcacagatgattctatcatcgtttgcggtaaagaaatcaaaatctacgctttcccagatgcaaacaactgcccatggggagatttaaaagttgacgttgtattagagtgctccggtttctatacaagcaaagaaaaagcacaggctcatatcaatgcaggtgctagaaaagttgttatctctgctccagcaggaaatgaccttcctactatcgtttataatacaaaccacgagacattaaaagcttctgatacaatcatttcagcagcttcctgtacaacaaactgcttagcaccaatggcagatgcattaaacaaatatgctccgatccagtctggtatcatggtaacaatccatgcttacacaggtgatcagatgactcttgatggacctcagagaaaaggtgatttaagaagatcccgtgcagcagcagttaacatcgttcctaacagcacaggtgctgcaaaagcaatcggtcttgttatcccggagttaaacggtaaattaatcggatctgctcagcgtgtaccgaccccaacaggttctacaacaatcttaacagcagttgttaagaaagctggcgtaacaaaagaagacatcaacgcagctatgaaagcagcagctaacgagtctttcggttacaacgaggatgagatcgtttcttccgatatcgtaggaatgagatatggttcattattcgatgcaactcagacaatggttaaccaggtatctgatgaccagtacgaagttcaggttgtttcatggtatgacaacgagaactcttacacatctcagatggttcgtacaatcaaatacttcagtgagttagcataatcgacgggttacgataactatatgcgacttttagcaggtccggtcctattggaccgggcctgtttttatacctcaattatataaaaggaggacatattttatgtcattaaacaaaaaatctgtagacgacattaatgtaaagggaagaagagtacttgtaagatgtgatttcaacgttccgttaaaagaaggaaagatcacagatgagacccgtatcaacgcagcacttcctacaatcaaaaaattaatcaatgatggcggaaaggttatcctttgctctcatcttggaaaagttaaaaatggaccaaatgaaggtgagtctttagctcctgtagctgtaaaactttctgaaaaacttggcaaagaggtaaaattcatctctgattatcatgtaacaggtgaggaagctaccaaagctgttgctgaaatgaacgagggagatgtaatcttattacagaatacacgtttccgtggtgctgaggagacaaagaacggcgaagagttcagcaaagagttggctgatcttgcagacgattatgtatgcgacgcattcggttcctcccacagagcacatgcttctgttgcaggcgttacaaaattcatcactgcaaagggtggttctaacgtagttggttacttaatgcagaaagagatcgatttccttggaaacgctgttgaaaatccggtaagaccgttcgtagcaatccttggtggtgcaaaagttgcagataaattaaatgttatctctaacttattagagaaatgcgatacattaatcatcggtggtggtatggcatatactttcttaaaagcacagggatatgagatcggtaaatctttagtagatgatacaaagatcgattactgtaaagagatgatggcaaaagcagaaaaacttggaaagaaattactccttccggtagatgctgtaaccatcgcagatttcccgaacccgatcgatgctccggtagaagttactgtatgtgacgtaaaagatatgccggctgacagagagggatgcgatatcggaccaaagactcaggagttatatgctgatgcagttaagacagcaaagactgttgtatggaacggaccgatgggtgtatttgagaacccgacattagcagctggtacgatcgcagttgcaaaagcacttgctgatacagatgctacaacaatcatcggtggtggtgattccgcagcagctgttaaccagttaggattcggcgacaagatgagccatatctctaccggtggtggagcttcccttgagttcttagagggtaaggaattaccaggtgtcatggcagccgatgataagtaaaaaatagctgcagtgtaaagttggctgccatgacgccttggggtggcagccgatgataaataagatcaacaaactttaaaatgggaaaaagaggataagatcatggcaagaaagaaaatcgtagccggcaactggaaaatgaacatgactccaagccaggctgttaaattagtagaggaattaaaaccattagtagtaagcgatgatgtagaagttgtttactgtgtaccagcaatcgacatcgtacctgttgttgaggctgtaaaaggaaccaacgtagcagtaggcgctgagaacatgtactatgaggagaaaggtgcttacaccggagagatcgctccagagatgttagttgacgctggcgtaaaatacgttatcatcggtcattccgagagacgtgattacttcaaagagtgcgactgcatgttaaacaaaaaagtgaaaaaagctttcgagcataacttgacaccaatcctttgctgtggtgagacattagagcagagagagatgggaatcactttagactggatccgtatgcagatcaaatctgacttaaaagacgttactgcagagcaggttgcttctatggtaatcgcttatgagccgatctgggctatcggaacaggaaaaactgcaaccacagagcaggcagaggaagtctgcaaggcaatccgtgactgcatcaaagaagtatacggtgctgacactgcagagaaagttcgtattcagtacggcggatctgtaaatgcaggtaatgcagcagagttgtttgcacagcctgatatcgatggtggtttagttggcggagcttccttaaaagctgatttcggtaagatcgtaaactataaataaatcataatcaggttaaggggattctctctgggagtgaaagcagaaggaatccccttttcccttgatatatgcggaaaatgtgaaatatatgaaaaagaaaatagcacggatcctgatatgtgtcctgattataatctgcggttggaacgtgatggtaagagaatggaaccaggcaggaaaaacggattcggaatataaagaaaataatgcgaatgcaagggcacagagcgctaacagtcaggacgtttcactggaagacgatttacaggaaacggagacgtccttacaacatagtggatcaaataacagatcagaaaatgagaatataacaggtaattccgggaactcatcgggaaaaaatgaaagagacgatgaaaaagcggatgccgatgacagcataaaaacagatgtaacgaaaaatgaaacggatattgcggacaatcaggtcaacggggatatggaaataaaaaatgaaccggcagaagaagagccgaccgaagatccctatgaatatgaaaccgggtatatttttctgggagattccagattttatctgatgaatgaggaatgcaaaatcgaagatgtgccgaatttttttgtggtatcctgtcctggaatgggatatgcatggctggcagatactgcgttcccgaaggtacagtcgctgcagcggcagcatacggaaattaaaaactggattgtgatctgtggactgggagtcaatgacctgacatcgatccgttcctatctgaacaaatatcgcagatggccggaaagttcaaaactttatctgttgtctgtgaatccgacaaagtcaggtgctccggtaagatgtaataatcagaggattgaagcatttaataaccgcatcaagaaggtggaaaatgctacatatatcgattgttaccgatatctgacgaatcttgggtttggaacaaaaggagacggactccattatgatgcgcccacgaactgggcgatttattcctatatattagaaaagcttaataaggatgccggaggggatccggtcacggaaacagaatgccaggcaaaggcaaagaagtttgaaaaacagctgagccagaaaaactattgaaaacagatgaggttatcagtataatggttctggattaggagaatcgtatacttttgataaatggaaagagaatagaaagtgaggaaacaaaacatgagtaagaaacctaccgtattaatgatcttagacggatttggactgaatgaaaaaacagagggcaatgccatagcacaggcaaagacaccggtgatcgacggacttatgaaagactatccgtttgtaaaaggaaatgcaagtggtcttgcagttggtcttcctgacggacagatgggtaactctgaggtaggacatttaaatatgggtgccggaagaatcgtatatcaggaactgacgagaatcacaaaagaaatcagcgatggcgatttcttcaaaaatcaggcattattagatggtatggaaaacgtaaagaaaaacggttccgaccttcatttatacggactgttatcaaacggtggtgtacacagccacatcacacacctgtttggcctgcttgaaatggcaaaaaaagagggcgttgagaatgtatatgtacattgcttcttagacggacgtgatactgctccgacttccggtaaagagttcatcgaagaactggaagctaagatgaaagaaattggtgttggcaagatcgcatctatttccggacgttactacgcaatggatcgtgataacagatgggatcgtgtggagaaagcatacaaagtgctgaccactggcgagggagaaactgctgagagcgcagtagcagctatggaagcatcttatgcaaaagatgtgacagatgagttcttcgttccaactgcaattacagagaacggcaaaccgatcgcaacaatcaaagacaacgatactgttattttctttaacttccgtcctgaccgtgcgcgtgagatcacaagaacattctgtatggatgattttgatggatttgaccgtggcgcaagaaagaacgtaaaatacatctgcttcacagagtatgacgtgacgattccgaacaaagaagttgcatttaagaaagtagaactgaaaaatacatttggtgagtatttagcagcacatgatatgacacaggcaagaatcgccgagacagagaaatatgcacatgttaccttcttcttcaacggcggtgtggaagagccaaacaaaggtgaggatcgtattcttgtaaaatctccgaaagtagctacctacgatttacagccggagatgagcgcaccggaagtatgcgacaagttatgtgcagcaatccgttctgagaaatatgatgtcatcatcatcaactttgcaaacccggatatggttggtcacaccggaatcttagacgcagcgatcaaagcagttgagacagtagatacctgtgttggaaaagcagttgaggcattaaaagaagtagacggacagatgttcatctgcgcagatcacggaaacgctgagcagcttgtaaactacgagaccggcgagccgttaacatcccacacaaccaacccggttccatttattctcgtaaatgcagatccttcctacaccttaaaagaggacggatgccttgctgatatcatcccgactatgatcgagctgatgggaatggagcagccggcagagatgacaggaaaatctttactgatcaaaaaataaaagagcgatataatatagccggataaaaagatgccacagactggtatatttatttttggacaggcagggcagctgctgtcagaaagaaatttatcagttttgtggcactttttttgaaaggaaaaggatcattttccggtaaaattcatgcaggaaagaagctgagaaagtgagaataagagaatataaacaaaaatataagtacaacttataatatgattaaaactatacaaaaatactaataaaaagaactgatttttctatatcacatatcgatgtccatacgggcaaaatcattgactttccaaaagactatgtattataatttttgagtaacatcagaaaatgatatggtgcttataacaccggaaaagaggacaaagaggatgagtagcaaagtatttcagccaattaaagagggaaaagtacgtgaagtatatgataacggcgacagcctgatcattgtagcgacagacagaatttctgctttcgatcatattttgaagaacaaagtcactaaaaagggtgcgattctgactcagatgtctaaattctggtttgatttaacaaaagatatcgttccaaatcatatgatttctgttgatgtaaaagatatgccggagtttttccaggaggagagatttgacggcaacagcatgatgtgcaaaaaattagagatgcttccgatcgagtgcatcgtccgcggatacatcacaggaagcggctgggagagctataaagaaaacggtaccgtatgcggcatcaaactgccggagggattacaggagtccgacaaactgcctgagccgatttttacaccgagtaccaaggcagagatcggtctgcatgatgagaatatctcctttgagcgctgcagagagatcttagagaaagagtatccgggaaaaggtgcttcctacgcagaacagatcaaagattatacgatcgctttatataaaaaatgtgccgaatatgcactgacaaaaggtatcatcattgcagataccaagtttgaatttggtttagatgagaatggcaatgttgtattaggggatgagatgcttacaccggacagctccagattctggccattagagggttacaaaccgggacagggacagccgtcctttgacaaacagtttgtaagagactggttaaaagcaaatccggacagtgattacctgttaccggatgatgtcatcgaaaagaccgtgaataaatacaaagaggcatatgagcttctgacaggtaagaaatttgcttaatggagatacatttatggacaacaatggatttgtgaaagatacaccatggcagacgaatggggacagcggactgcacgaggaatgtggtgtattcggaatgtacgactttgatggcggagacgttgcgtctacgatctattatggtctttttgcattgcagcaccgtggacaggagagctgtggtattgcggtcagtgagacgaacggacccaagggaaaggtgacctcatacaaaggcatgggacttgtcaatgaggtattcacgcaggataatttagagcctatgcatggcgatatcggtgtcggacatgtccgttattcgacggcaggagcttccacccgtgagaatgcacagccattggttcttaattatgtaaagggaacgttagcgctcgcacacaacggaaacctgatcaatgcaatggaactgcgcaaggatttagagtataccggagcaattttccagacgacgattgactctgaggtcatcgcctatcacattgcccgtgagcgtttaaattcaaacagtgtggaagaggcagtgggacgtgcctgccagaagatcaagggtgcgtttgcactggtagtgatgagcccgagaaagttagtcggagcgcgtgatccgtacggttttaaaccgctctgtattggaaaacgtgacaatgcctacattttggcatccgagacctgtgcacttgatacgatcggcgcggagtatgtccgtgatgtactgccgggagagatcgttacgatcacaccggagggcggcattcagtctgacctttctttagcactgccaaaagaaaaagaggcgcgctgtatttttgaatatatttactttgcaagaccggacagccatatcgacggtgtcagtgtctatgcatccaggatcaaggcaggacgtttcctcgccatggattcaccggtggatgcagaccttgtcgtcggtgttccggagtccggaaatgctgcagcactcggttattccctgcagtcggggattccgtatggcactgcatttgtgaaaaacggctatgtcggaagaactttcatcaagccgaaacagagcagcagagagtccagcgtgcgcgtgaaattaaatgttttaaaagaggcggtcgatggaaaacgtatcattatgatcgatgattccattgtccgcggtacgacatcagaccgcatcgtaaaaatgctgcgtgatgccggtgcaaccgaagtgcatgtaaggatcagttccccaccatttttatggccgtgttactttggaacagatatcccggagagagaacagctcattgcatacaatcgttccattgaggatatccgtaagatcattggtgcggattcccttggttaccttgggattgagcgtttagaggagatggtcggcggattaagtatctgtaagggatgctttacgggtacctacccgatggaaccgccgaaagaagacatccggggcgattttgagagatagataataacaaatgttaaggagaacagaaatgagtacagacagatatacaagtccgttatctgagcgttatgccagcaaggagatgcagtatattttttcacaggacaaaaagttccgtacctggagaaaattatggattgcattagctgagacagagatggagttaggactttccgagaatggaaagccggttattacacaggaacagatcgacgagttaaaggcacatgctgaggacatcaattatgatgtagcaagagagcgtgaaaaactggttcgtcatgatgttatgagtcatgtatatgcatatggacagcagtgcccgaaggcagcaggaatcatccatcttggagcaacatcctgttatgttggtgataacaccgatattattttaatgagggaggcattggagctggttcataaaaaactggtcaatgttatcgcagaacttgcaaaatttgcagatacttacaaaaatctgccgacactggcatttacccatttccagcctgcacagccgacgactgttggaaagcgtgcaacactgtgggcacaggaatttatcatggatcttgaggacctagagtatgtcatgggatctttaaaactgctcggttccaagggaacgaccggaacacaggcaagtttcttagaactgtttgatggagatcaggagacgattgacaagatcgacccgatgatcgctgcaaaaatgggattcaaagagtgctatgcagtttccggacagacttattccagaaaagtggatacacgcgttgcaaatattcttgcaggtattgcggcaagtgcacacaagatgtcaaatgatatccgtttgttacagcacttaaaagaagtggaagagccgtttgagaagaaccagatcggatcttctgccatggcatacaaacgcaatccgatgcgttccgagcgtatcgcatctttatcgcgttatgtcatgatagatgctttaaacccggcgatcacttccgcaacacagtggtttgagcgcaccttagatgactctgcaaacaagagactttccattccggaaggattccttgcaatcgatggtatcttagacctgtgcttaaatgtagtggatggattggttgtatatgataaagtaatcaccaaacatttaatggcagaactcccgtttatggcaacggaaaacattatgatggacgctgtaaagaatggcggcaaccgtcaggagttacatgaaaagatccgtaccttatccatgcaggcaggaaagactgtcaaagaggaaggaaaagacaacaatctgcttgaactgatcgctgcagatcctgaatttaacctgacattagaggcactgcagtccacgatggatccggcaaaatatgtgggacgtgcaccgatccaggtggataaattcattgcaaatgtggtaaaaccgattctggatgcaaacaaggaagaacttggtgtaaaagcggagatcaatgtataataatggatcataatatggcctgtatcagtaatttgctgatacaggttttttgttacaattttgctgttttgtcacttacgaaaacgataggatcctgttacaatcaaagtatcataagtattgaaaaaggagaaggttattatggcaaacagaattatgttaaacgaaacatcttaccacggagcaggggcgatcgaagagatcgcaacagaggcaaaggcgcgtgctttcaaaaaagcatttgtatgttctgatccggatctgatcaaatttggtgttacaaaaaaggtaacggatattcttgacaaaaacggacttgcttatgaaatttattcagatatcaaagcaaaccctacgatccagaatgtacagcacggcgttgaggcatttaagaaagcggaagctgattacctgatcgcaatcggtggaggatcttctatggatacctcaaaagcgatcggaatcattattgccaatccggaatttgaggatgtcagaagtcttgagggagttgcacccacgaaaaaaccatgcgtaccgatcattgcagtacctacgaccgccggtactgcagcagaggttacgatcaattatgttatcacagatgtggagagaaagagaaaattcgtctgtgtcgatccacatgatatgcctgtcattgcaatcgtggatccggatatgatgtcttccatgccaaagggactgacagcttccaccggtatggatgccctgacacatgcgatcgagggatatacaaccaaagctgcatgggaaatgacagatatgttccatctgaaagcgattgaaattatttcaagatccctgcgtgatgcagttgacaacaagaaagagggacgtgagggaatggcacttggacagtacattgccggaatgggattttctaacgtaggtcttggaattgcacattccatggctcataccttaggtgctgtttatgatacaccacatggtgttgcatgtgccatgatgcttccaatcgttatggagtacaatgcggactgcactggagagaaataccgtgagatcgcccgtgcaatgggagtcaaaggtgtggacgatatgtctgtggaggaatatcgtaaagcagcagttgatgccgtacagaaactctctgttgatgtgggaatcccgacaaaacttgaggcattaaaagaagaagatcttgattttcttgcagaatctgctcatgcagatgcatgtgctccgggtaacccgaaagatgccagtgtggaagatcttaagaatcttttccgcaaactgatgtaattgcagcggtgaaatcatagaatgtatgctttatgattcgtatattgtcataagtaaaagaaaacctttcaggcataattgttttgcctggaaggtttttttgtaacagaaatgtttatgaatgtaacattttcctgcatcaaaccaacccgtatttatgaaatacagtctgcagttcttccggcatggcagatgcaagggcatgtgcgagttcttcggcagaacatttgcgatagccaagcacccactgtacggtcatataaatggaaccctggcagtacatttctaactgaaactgcagctgacgggaaagtctgcacgccatgcgcgtctcaagctgttcggtgtaaaatgcacagatcagttgaaaatcatgatctctcagacaattctgatcgtcatttttaaaagctgctttaaaaaagagcttttcctgctggatataatgaaatttatttaccagtccttcatacacagttttcccttcacccatatgttcgaaagattccagtaaaattttatcaaaataccagttgataaggtcatacttatccttaaaattccggtaaaaggtctgacgtgtcacgccgcaggtctccacaatctccgtgacggtgatcttctctacggaggcggatttcatgcattctttcattgcggtggcaagtttgtatttgatggtttcatttgttttatgttctgatggcatgggaaaatctctttctttttacgttgtgattagttcgtgctggtctgtattttattccgcagtgttccttcttatctggcactgctcatagcttaatacattataccatacatggtcaggaacaaagcgaatttatagagattttataaagtggtattttaagaaaaaacaacttgttaacacatgcatacaagttgtatgctgaaagtatagaaaaagtggtttacatctgaaaggagaagggataatgagtaacgcaaagcagacgattgaaaccggaaaagcagtacttggtattgaattcggttcaaccaggatcaaggcggttcttgtaaatgagacgggggagccgattgcatccggtgcacatgactgggaaaaccgtttggaggatggcatctggacatacagtctggatgatatctggacgggacttaccgactgttatggcagattagcagaggatgtaaaggaaaaatacgatacggtgatcacatcactcgcagcgatcggattttccggaatgatgcatggctatatggcatttgacaaagacggggagttacttgtaccgttccgcacctggcgcaatacgatcacgggggaggctgcggcagcacttacaaaggagttttcctttaatattccacagcgctggagcatcgcacatttatatcaggcgatcttaaacggggaagaacatgtaggaaacatttcgtattttacaaccttagccggatacattcactggaaactgaccggagagaaagtacttggtgtcggagaggcatccggtatgttcccgatcgacgcaaagacaagagattacaatcagacaatgatcgataaatttgacgcacttgtcgcaccaaaaggatatccgtggaaactgcgtgagatcctgccgaaagttttagttgcaggggaggcagcaggaacgttgtctgctgagggagcaaaactgttggataagagcggcaatctttccgcaggcattccactctgcccgccggagggagatgcaggaaccggtatggctgcgacaaattccgttgcagtccgcacaggaaatgtatctgccggaacatccgtgtttgcgatggtcgttctcgaggaagatttaaagaatgtacatgaggagcttgacatggtaaccacaccgtccggtgataccgttgcgatggttcactgcaataactgtacatcagacctgaatgcatgggttggattattcaaagaatttgcagaagcctttggcatgaaaccggatatgaatgagttgtttggaacactttaccggaaagcattagagggagataaagactgtggaggcctgcttgcctacaattatttctccggtgagccggtaaccggtttaaatgaaggccgtccgcttttcgtgcgcagaccggatgcacattttacactggcaaactttatgagaagccatctttatgcatcacttgccacgttaaagatcggtctggatatcctgttaaaagaggaaaaagtaaaagtagaccgcatttacgggcatggaggactgtttaagacaaaaggagtcggacagggaatccttgctgcggcaatggatgcgccggtagcagttatggaaactgcaggcgagggcggcccatggggcatggcactgcttgcatcatacatggtacacaaagcagaaggcgaaacattagagcagtatttatccggtaagatctttggtggggaaacaggaactgtcatggagccggatccggcggatgtggcaggatttgatgcttatattgaaaactataaaaaggcactggaagcagaaatggcagcggtagagacgatgccgatcttataaaaataataaaaaaataaagtgtatcaggagggaatttgcacatgttaaaaacaaaaaattataaattctggttttgcaccggatcacaggatttatacggggatgagtgcttagagcatgtggcagagcatgcaaagatcatcgttgcaaagttaaatgagtcaggggtacttccttatgaagtcatctggaaaccgacactgatcacaaacgagctgatccgtaaaacgtttaatgaggcaaatatggatgaagagtgtgcaggtgtcatcacatggatgcatacattttcaccggcaaaatcctggatcttaggtttacaggagtacagaaaaccattattacatttacatacacagttcaatgaagagatcccatatgattccatcgatatggatttcatgaatgaaaaccagtctgcgcatggtgacagagagtacggtcatatcgtgacccgtatgagaatcgagcgcaaagtggttgtcggacactggtctgatccggtggtacaggagaagatcgcttcctggatgcgcaccgcagtcggcgtgatcgagagcagccatatccgtgtgatgcgtgtcgctgacaatatgagaaacgttgcggtaactgagggcgataaagtggaagcacagttaaaattcggctgggaagtggatgcatatccggtcaacgagatcgcagagtccgtagcagcagtatccgagtctgataccaatgttcttgtggacgaatactacgagaaatatgacattttattagagggacgtgatccggaagaattccgccgccatgttgcagtccaggcacagatcgagcttggctttgagcgtttcttagacgaaaagaattatcaggcgatcgtaacccactttggagatcttggtgcattaaaacagcttccgggacttgcaatccagcgtctgatgggaaaaggttacggatttggagcagagggtgactggaaagttgctgccatggtccgtctgatgaagattatgaccgagggcaaaaaggatgcaaagggaacatccatgttggaggattacacctacaactttgtcaaaggcaaagaaggaatcttagaggcacatatgttggaaatctgtccgtccatcgcagatggcccgatcagcatcaagtgccagccactctccatgggtgacagggaagatcctgcaagactggtattcacatccaaagaaggtaaaggtatcgcaacttccctgatcgatcttggcaaccgtttccgtctgatcatcaatgatgtggactgcaagaaagtggaaaaaccgatgccgaaactcccggtagcgacaaacttctggacaccacagccggatctctataccggtgcagaggcatggatccttgcaggcggcgcacatcataccgcatttacatacgatctgaccgcagagcagatgggcgactgggcaaatgcaatgggcatcgaggctgtttatattgacaaagatacgaagatccgtgatttcaaacgtgacttacagattggggaactgttttatcgttaaacactggaaaagcatgtgcatattttgaagcaaaaacttgttttgtgaaaagtgtgcacatgcacgcaaaaaagttgtgcaaaatcatgaaaacacaaaaacacgcttgaagttttaaataaaagagattatcataagtaaaacaagttgtgtgcacgggcacacaaagaaaaggagaggtatagtatgaaattttttattgacacagcaaatgtagaggatatccgtaaagcaaatgatatgggagtgatctgtggtgttaccacgaacccatccctgatcgcaaaagagggaagagattttaacgaagtaatcaaagagatcacatccatcgtagacggaccgatcagcggtgaggtaaaagcgacaactgttgatgcagagggcatgatcaaagagggacgtgagatcgcagcgattcatccgaacatggttgtaaaaattcctatgacagtagaaggcttaaaggcagtaaaagttctctctgcagagggcatcaagaccaatgtaacactgatctttactgcaaatcaggcactcctcgcagcaagagcaggcgcaacctatgtttctccattccttggaagattagatgatatcagtacagcaggcatcgatctgattcaggatattgttcagatctttgacaactatggacttgagacagagatcatcgcagcatccatccgtaacccgatccatgtcacagactgcgcattagcaggtgcacatatcgcaaccgtgccgtacaacgtaatcgtccagatgacaaaacacccactgaccgacgcaggaatcgaaaaattccagaaggactataaagccgtcttcggagagtagaaatagcttggaaaactataaagacggctttgcggttttcggtgactaaggttttacaaaaagactatagaaaccgctctgccgtcttcggagagtaaaaatggtttgaaaaactacaaagacggctttgcggttttcggtgactaaggttttacaaaaagacaatagaaaccgctctgccgtcttcggagagtagaaatagcttggaaaactataaagacggctttgcggttttcgcagagtttatatgacactaaaggagggtatcaatgactatcacagaactgaagcagactgcagtcgaggttcgcaagggcatcgtgactgcaacgcatgctgcgaagtcggggcatccggggggatcgctttcggcgacagaaatttttacatatttatattttgaagagatgaatattgatccaaaaaatccgaaaatggaggatcgtgaccgctttgtcttatcgaaaggacatacggcgccgggactttattctgcgctggcaaaccgcggatattttccggtgaaggatttggagacattgcgtcataccggttcctatttacagggacatccggatatgaagcatattccgggagtggatatgtcatccggttctttaggacagggaatttcctgtgcggtcggaatggcacttgcaggaaagatggatcacaaagattaccgtgtttatacgctgttaggtgatggcgagatcgaggaaggtcaggtgtgggaggcatccatgtttgccggacaccgtaagcttgacaatctggtagtgatcgtcgacaataacaacatgcagattgacggaacattagatgaagtctgctcaccggatccgatcgataaaaagtttgaagcttttaatttccatgtgatccatgtcgcagatggaaatgattttgcacagcttgcggaggcttttaaagaggcaagggagacaaaaggcatgccgacagcaatcatcgcacataccttaaaaggaaaaggtgtttcttatatggaaggtcaggtaggctggcacggaaaagcaccgaacgatgaggaatatgcgattgcaatggaagaactgggaaaggcgggtgaagcattatgtcagaagtaaaaatgatcgcgaccagagaaagctatggcaatgcattagccgaacttggaaaagaaaaagaaaatctggttgtgctggatgcggatctcgcagcagctaccaagacaggtatctttaaaaaagcgttcccggagcgccatattgactgcgggattgcagaggcgaatatgacaggaattgcagcaggactttccacctgtggaaaagtaccgtttgtcagcacatttgccatgtttgcagcgggacgtgcctatgagcaggtgcgcaattcaatcggttatccacatctgaacgtaaagatcggagcaacacatgcaggcatttctgtcggcgaagatggagcaacacatcagtgcaatgaagatatcggactgatgcgtgaaattccgggcatggttatcattaatccgagtgatgatgtggaagcgaaggcagctgtgcgtgcggcttacgagtatgtgggtccggtttatctgcgttttggacgtctggcggttccggtcatcaatgataatccggaatataagtttgaaatcggtaaaggtgtggaactgcgaaaaggaaaagatatcacgatctttgcgacaggtctttgtgtgtcggagacgttaaaagcagcagaaactctggctgcaaatggtatcgacgcacaggtcatcaatattcatacgatcaaaccgttggatgaggaactggtgttaaaagcagcaaagcagaccggtcgtgtgtatacggtggaggagcattcgattattggaggacttggcagtgcagtggcagagctcctcggtgaaaaatgtccgacaaaaatcacaagaatcggtgtaaaagatgtgtttggagagtccggaccggcaaaagaactgcttcataaatatgagctggatgcagagggcattgcaaaacgtattatggaggaacagaaatcatgttagaggaattaaaaaaacaggtctatgaggcaaatatggaactgccacgccgcggattgatcacctatacatggggaaatgtcagcggaattgacagagagagcggatattttgtgatcaagccaagcggtgtggattatgatgcattatccccggatgatatggttgtcatggacttagagggcaataagatcgagggaagatacaaaccgtcatctgacacggcaacgcatattgaactttataaaaaatacgaagagatcggtggaatcgtacatacccattccccggaagctgtcgcatgggcgcaggcaggaagagatatccctctttatggaaccacacatgcagactactttttcggtccgatcccgtgtgcaagaaacctgacgccggaggagatcgaggaagcctacgagaaaaataccggattagtcatcatcgagacatttgagacaagaggcatcaaaccgatgtatacaccggcggtactctgtaagaatcacggaccgtttacctggggaaaagatgccgcagaggcagtccacaatgcagttgtgttagaggaagttgccaaaatggcaaagaatacagaacttttgaacccgaaagtacttccggcgccggactgcatcaaagaaaagcatttttaccgtaaacacggcgcaaatgcatattacggtcaaaattaaaaacagcggcggaaataaagatgcgcggaaatgaggattaagatgagtggtattgagtttggaaaaacaaaagaaggaaacacagttacaaaatatctgctgaaaaataaaaatggtatggaagttgctgtgatggatcttggggcaacgatcgtatccgtgctcgtgccggataaaaacggtttgaagcgcgatgtcgtgcttggatatgatacaccacaggaatatcaggagcatacctgttattttggggcagtgatcggacgtaatgcaaacaggatcggcggagcgaaaattgttttggatgacagggagtatccgcttgaaaaaaatgacaatggaaacaacctgcacagtggaaaaaatggttttaattcagtcatctggaatgtggaacagcagaaagaagatgagattacattttcttatctgagtaaggatttagaacaggatttcccaggaaatatgactgcaaaggttacatatacagtaacagatgataatgcgctctcgattgcctatgaggcggtttccgatcagaccacagttgcgaacttcacgaaccacgcttattttaatctgaatggtcatgattccggatgtatggaaaatcaggagcttgaaattttagcatcctattatacgccggtaaaagatggcgaagcgattcctaccggtaatgtggaaaaggttgccggaacaccgatggatttccgcaaaatgaaaaaaatcggtcaggacatcggagtagattttgaacagcttaagtttgtcggtggatatgaccacaattttgtgttagataaggctgatgggacaatgcagcttgcagcccgcgcaagatcagagaaatccggtatctgtatggatgtctatacggactgtgtcggtatccagctgtatgccggaaatttcattggaaaacagaccggaaaaggcggtgcatcttatgattcccgccacgcattctgtctggaaacacagtattttccgaatgcagtgaatgaaccgaattttaaatccccggttttacatgtgggagaaacttatcattctcagacaaagtattgtttttctgtgaagtaacaggcagtatgctcagacgtagatctgtcagcatgaataaaagatgatgtataaaacagtgccacatctatttgaagaattcgatgactgccaatgcgtttgaggaggatcgcaagcgtgcacttgaggtaggtatggatggttatatcgcaaagccgatccatatggagagtgtgttagatgcgctgcaggaggggcttgcagggaaacattgaaagaaaactgattgatacgaattgacaatggttatgtatggttatattatgaatataaccatacataaccatttttgatgcataggagtatgagattgcagatggaggaatagaatacgaaatccgaaagatcgtatcagagagatagataaccggttagaacaactgccgaagggaacactgacttataagaatattaacggtaaaaaacagccgtatatccagcggacagtggagggaaagtcagtcagctgttatgttaagctatcacagcgggaacaggtactggcagagtttgaagaacggggaaagctttcggaagagaaaaagcggctgcttgcgtatgtggatggactgcagaatattttaaaacgaaatccatatctgaatgcgggagtcgggtgcggatatcaggattttaaagattttgcatgtggcagacagttttatgtggataagacacattttattgcagaatgggtttacagggatgcaaaagtcacgctgatcacgagaccaagaagatttggcaagacgacactttttagtacagttgagactttttttgatccgagatttgcagaccatccggaatattttgaaaagttaagggtctggggggataaagagatccgaaaactgtttggaatggttcctgttatttccatcagttttgggaactgtaagggagcagactataaacaggcggtaaaaggaattgcagacagtttttataatatgtatgaagcacacagatatctgctgaaaagcaccagactggaagcggaggatctaaaggaatataagagtctgagagaactgttccgtgcgggagataccggaaggattgaaattgcaatacagaggctgtgccgtctcgtctatctgcactaccagatcctgccggtcattttaggggatgaatatgatacacctctgcttgaagcatatacggatgggtactggagtgagatgatcggtacctgtcgtcagttatttcacagtacatttaaggaaaatccttactatgcgagggctttgattaccggagtgacgaaggtttcaaaaaattcgctgttttcggatctgaataaccttgaaacggatacggttacctgcgaggcttacagtgattgcttcggttttacggaacaggaagtaatggatgcattaaagtgccagaacatggatacgatgcatgatgtgaaagaaatgtatgatggatttatttttggaaaacaaaaagatatgtataatccgtggtccatctgtaattatatgaggtccggggaattgcagtcctactggatcaataccagcagtaacaaactgatcggggagatcatccgcagacatcctgtgcgtagcaaacatgagatcgaacagcttatggcaggggaaatcattcataaagagatcaatgaaaatgtcacgtttcaatatcttgacggtgacgagaacagtttatggtcactttttctggcagttggctatattaaagcggaaaatgttgtaaagcagggagagagcacatggtgcgatatgtcggtcacaaaccgggaagtgatgggaatgttccgctatgaaatccttgcgatgtttgaaaatggaaatgccgtttataatgattttacaaaagcactgctctcacaccgcatggaagatctgaatgatattttgctggatattgcatacacttccatgagttattttgatgttggaaaatgtccaccggagcgtacatcggaaaatttttatcgtggactggtgttaggactcatcgtatctctgcgggatcaataccggatcgtatcaaacagggaaagcggacaggggaggtatgatatcgcaatgtatccgttagagagaaataaggatgcatttatcatggagttcaaagtgtttgatgcgaaaaaagaacggagtttagagcagacagccgcgaatgcattaaagcagatcgaagagaaaaattatgaggcggatctgatcgcggcaggcatcggatggggacaaatctataaacgttactgttcagaggtaaacttgtaacaaaagaaccgatggtagactaatcgtagtcaaaaccatcggttttcttatgcaaatatttctgcaatctcgcggaacagattggtctgctctttcctgcgcatcaaaaccagcatgctcatgcatttacagagatggtcgatgcttgacggactccggaatgacacagcctgcgcctgttttcttttatattttctcagcagccgttcggcttcgttattcgtggcaggtacattcttattatggaggaaaagaagatgatctttcttatattttttcatccttttgtacaggttgtatccatcacggtagtatttcccaggcggctcatagtcgtattcatccccagctatggacaggattgttttataacgttcttcaaattcggaggcggtctgcggatctggctcttctgattcagataaaccattccggtaatggatcatttcctgtatcagggaatgcatctgcctgttccaggtacggtccttttcgttgtccatgctgtctttcagataacgcagtacatgtgcaaggcattcctggtggccggttccatacttataaaaggttacatcatgatcgtggaccagtgttcccctgatagtcttcaacgaccgtgccctttattccatcgtgtccctttttgcccctggcaaaatagagcacaccgccatccggaaccgcacatacaaatacatacgaactttccccgtttacacgggcattggtacagtctgtatgcatgacaggggaaagcagcatgtcgcagaaaatctctttacgctgggattctgttttttgggcaaatgaccggcagagattattgatcatgccttttgacttctttgggagtatgccggcacctatgcagagaagtaagctgtattgggtggagcttgacagcatttcgggaagaattgcaaagcagctttatcagaatgccaatatcagtatcacaggatttgagaataccacatatccggataacttctttgatgtggttgtcggaaatgtgccatttggagattacaaggtatttgatccaaagtacaacaagtataacttccgtatccacgattattttctggcaaaagcacttgaccaggtaagaccgggaagaatggttgctgtaatcaccacaaagggaacacttgataaggcaaatcctactatccgaaagtatatggctgaaagggcagagcttgtgggagcgataagacttccgaatactgcatttaaagacaatgcaggaaccgaagtgacagcagatatcctgtttttgcagaagagggagagaaagattgatattgagcctgacttggtacaccttggtgtaactgagaatggcattgctgtcaattcatactttgcagagcatccggagatgatgcttggatctatggaatatgatacaaggatttacggacaggacagcagatatacagtctgtgtgaataatgatgagaacttcaatatgtacgaggctctcaataaggcaatcggaaatatcaaagcacagatgacagattttgagagagtggcagatgaggcggagcagatggaggaagttatcccagctgatccggatgtgagaaactacacttacacattttatgaaggaaagctctattacagggaaaattctgagatggtaagaaaagaggtatcacagactgccgaggagcgaatccgaagccttgatgaaatcagacagataacaagagaactgattgatatccagatggatggctgcagcgaggaggagctttctgataatcagagacttcttaatgtgaaatacgatgcctttataaagcagtatggagccattacttcaaaagcaaacagaatagcatttcgagacgacagcgattacccacttctttgcagtcttgaggaagtaaatgaagacggggaggtgaaaaaagcggatatgttttataagaagacgattaaggcaaagactgtcatagacagggttgagactgctgtggaagcattaaatgtatccgttaatgaatttggatatgtaaaccttgcctatatactctctatctatgagccggatattacaaatgcaaaggaagagcttgcagaaaagtccgggaagacagctgatgagataacatttagtgatgaggctttggcagagcttagaagggcagttcttatggaagagctggacggaaaaacacttaccaatgaggaggtcataagagaacttcttgaattattaaagaaaaatgccatgaaagagcaggcaaacgatgtatttgagatatgcagctatgtggatggactggagaaaaaggttgattccatgacggaagaactcaccattatgcagaaccagatcaaagaaatgcaggaagatacgcttgtcaataatgctaaaaaggcattgtcagaagcacaggagaggctaggtaccagatgtgaacagataaagtcgcaggtattggaagtgaaagcacaggtcaaatctacagcaaagagcatagttgatgaagcaaaggcaaagggaagaactacattatacagggtgtcggagttcttaggaattaagaaaaggattcttgatatccgagagaatgtaagaggtgcaataaagaccacggataaagatatagcaaagacagcacttcttgcaaaaggatttcgtgaagctggtcagacagcagctaatgcattccgtacttttgctgacaaaccggaggtagattattctcagaaagagcagaaacatttcattacaaaggcagtacttgcccctatgaaagcagtgaaaaagatgcttgtatcaatggaacttcatctggatgcatctattgacaagttggataatctggctatgaatgtagaaatatgtttgaagatagaatgaaaacatctgcaattccggaaagggtatatgccctttgccaagcgattaaaagcagaacaatgcaggaaagcgatttgtgagagttgttagaaccatcgaatttgggtggttcaacaaaatatttcggaacggttcgtgatgcagcaaaacagttagggcttatttccgtaaaagaaggtgatgtatcattggcagtagattcaaagtgtgtaagactgaagttgctgatagtgcatttgcagattgcagaagattatcggatatagagtatggtcaatgggacttttcagatactgaagatatttatatttccgatgcaccaatgcgtaaaatgaggagaccattttttaggattaaagtgatacttaagaatgaaccaagattggagagtgagattgtaatggagaaagcgaaaagattatatgagtatattgcagaacactctgacctacagaaggaaatttctaatattttgccagatgatattataagcaatattttgaatggctcactaccggtgttcccgcatgaagatcttggtataatagtagatgagaatgaacttattcattatatgaatcatgcagtattatataaagaagttggtgatagcaaaagcgaatgccttgcagaaaataatgggacaagatggatatgttaagggcgaaggcccattaaaacactaatgcgtaaattgaacgaggaggtcataagagaacttctcgaattactaaagaaaaatgccatgaaggagcaggcaaacgatgtatttgagatatgcagctatgtggatggactggagaaaaagattgattccatgacagaagaacttaccaatatgcagaaccagatcaaagaaatgcaggaggatacacttgtcaataatgctaaaaaggcattgtcggaagcacgggagcgacttaataccagatgtgagcagataaagtcgcaggtattggaagtgaaagcgcaggtcaaatctacagcaaagagcatagttgatgaagcaaagacaaagggaagaactgcattatacagggtgtcggagttcttgggaattaagaaaaggcttcttgatatccgagagaatgtaaaaggcgcaatcaagaccacggataaggatatagcaaagacagcacttcttgcaaaagaatttcgtgaagccgggcagacagcagctaatgcattccgtacttttgctgacaaaccggaggtagattattctcagaaagagcagaaacattcaattacaaaggcagtacttgctccgatgaaagcagtaaaaaagatgcttgtatcaatggaacttcatttggatgcatctattgataagctggataatctggctatgaatgtgaagcttgataaggaaaagcatatggagaatattaagaagcaggaacagacagagccggagagggcagaagctgagcgagtagaagcagagattgtatattcaccgatggtcgctgagccgcaggagtatcagtataatgcagacgcatttgaggctagaggtgtggatgaggtgaagcaggatgtggcataaaaggaagcaccgaaggtaagagaagataaagccagatagttttgagggcgtgggagaaaacccaatgtcatttagataaggattgctttatagtcagaaattcttatacagcggataaacattttgtttatctgctgtatttctatcttataacacttttaacataataaatttgcacaacaaacagacagatgctttcatctgccttaaaaatggtatatactaatatttgtttaagctgctctatatagaaagcttatcgccgactggggcttgactttgcgagggtctgttctcccaggacgtataggaagaagctcatgtccgattagatattctacatcgggtggagctttttcttttttaatcgatagaaagtaacagcaaatccgaattgctcgggtatagttgagctgatatgtatgtttacagccttttttctcatttataacaacattagttgctataatttcacagaaattatacagagtcattcttgaccatatttcctgcataatatattctggtttctttgaatgaaaacgtgttagtcctaaggcatatttcaattctcgaaaagaggtttctattccccaacgttttgcatataaccgtttgatttcatcagaattaaatttatcttgtggcagatttgtaataatgcattcataagaaccttgaggtattggaaaacgtatcactctcattttcatttcgtaaaaattattaaaatgcagatcaagataatcaaaaggcgttttcttatcaataactctgtattttttgggatttgcttttacttcatttgtctgctttttagtaagcgtaacattaacccattcatcaaattccccactctctggaagcattgtaagttttgaagttataccattacttgttatatctttgacacgaattaaataatacattcctttgtgttccacatgggcaaatatattataattctcataacccctgtctgcgataaaaatagctgatgtatcattgtatcggtcaatcatttcacacattgcacgtctttcattcgccaagcgtgaaggctggataattgcatctgtgtattggcggctgcataaatcataaaaagcatttaaatgcaataggttgtacccttttctgtcaggaagagtttgaaaataggttgtttcatcttggggattgtgtgcaatgcacaaatccgagccatcacatgcaatcagtctaagaccattatatgtaacattatccgtaaaagactttgtaaattcttggaataaaaattcaaatgcttcaggcaatatctgtgctctacgctgattgaatgaagaatttgatggtgtagtattatcaaattcaaaatattccaacagttcatctcttaatgctttgccttccattgtaagcatgaacttcataacctcttcaaatgaccatttctttttacgggaaaagtccgtttttggatgctttgtaaatagccaatagtaagaatccatttttgtaataattgatagtaatttttgttttacctctgtagaataattcatcgtgtaattctccttgcaatcaagatattttcttaattacaagggtcgctctaactatcttaaaaaagatagttagagcgaccgcacattttgattatcatgtcaagtgcttaacataattttacaaaaaaagaacagggtacatatttctatatacactgttctttgtataatccttatctaaatgacattgggagaaaacctgcgtcctttttttgtcgcctgaaatgcgacacataagaaatggttcttgttataattatgatagcacatgaaataagaatcgtttgaattcatagttgtcctttttattggacacatggtgtgcgtataatgtaaatacaaagaactttaaaacatgtaaaaattgtttgaaaggagctgattgatatgaaaaaagaaggatatagtcgccccggattatttggtacaatgaatcattacgataatagaggtcacaaagtaggacacagccgccctggattatttggaagtgtcaacacatatgataataatggacataagacaagccatagtgacagaggtttgtttggtggattcaatcattacgataattaggaggacagggatatgttaggaacagatggaagattatatgattcgaattttgactttgatggagatggaaaacttaatgcttatgagtattctgtaatggatgatgtagttttcggtcatgaagatacggaaacaagtgaggtggatgaactggaagatgagttatccttggcaggactagatgcaacagagcttgaatatatggatgcagatgaaagaagagaggcattgacaaacttaaatgtgagttatcagcatgggaaatggaacgtaatagggatacagctaagatacagtggcatttccaaacaggggatgcacgagaaaaactgatatcactgtatccgacactatcatctgtcactttttaattaaagtggcagatatactaaatttcaatgatacagtacactagatttgtactcattttacttaccgagatatggtaaaatatgcgattttatgctaggataagaccattgggttagatgtcgtgaaagtgcgataaaacctaggaaaaataaggatatacaaggaaaaacgaagatatgcaagataaaattaaagtgctttttatttgccacggcacaaaaagattgcacaggcaaaaacgcagtgttatcaagggtttgtgaggtttaatcaagaaaaaccacaccaattttacaccaagtaattagtagcaagaagattatgcgagaatgaggatcaaatgcaggaaaagtaggagaaatgttaagcagaaagaagatgcagtacaggtaagtattgtatctttttcttttctggaattgcaacacttattgaaatgtgactgctggttgttgaattgcccctgtgggcgtgtttgtggcgatttgcgacgttgtaaggagaaagagggagagttggacgataagaatctaaaacgcaaatttgggcgaaattgaaggaatgaaatctgccacaaaaagtagggtcgaaaatagtgcaggttaaaggagttatgccaccaagaggcggcataacccgtgaaacgcccaccggcagtgccgttggggcatttggagtatggcataacttttaaaacagagttttcaattattatgtcatattcgcaaaaatagccggaaacttacagaatataggggaaatttgttatgccatgaggaaaggcaccaaggggcaagtatgcccattccgtggactatggtataggtcatggtgaaccatgcagttaagtatataatttaagtaataaagacagagaaaaagaagtattcgtgttgacttttatgccatgcggaaatataattataagcacagaagtcaacaaaaagaaagggaactattgtgggagcaactgaagaaattatcaagatggcaaaagagaataatggtacggttactactgcaatggtggttgcagcaggtatttctcgtggaaatatcaaataccttgtcgacaagggaatgattgaaaagtcagcaagaggtgtttatattttgccggaggtttgggatgatgagatttttaatttgcagagtcgatttaaacgaggaatctattctcatgaaacagcattgtttctttggaatttaaccgacagaacaccgaacaggtattacatgacgttcccggcgaattataatttgacaaaacctaaagaagaaaacattcgctgtgtgcagtgcaaggaagcgctgtatgatttaggagtggtagaagtgcttacgccaggaggaaatacagtaaaggcttatagtgtggagcgcacgctctgtgatattttacgcccacatagtcatgtggatattcaggtggtgacggaggcgtttaagcgttatgcgaccagaacggataaaaatattccgcttttgtcagagtatgcaaaaaccttaaaggtagagaaaaaactcagagcatatctggaggtgttgttatgaaaaatgcaatgcagttaaaagcgattataaagaatcttgcaaaggaaaaacatatatccgcacagcttgtaatgcagaattttatgttggagagattgctggaacgaatatctatttcaaaatatcagcagaattttattttaaaaggtggtttcttgattgcagcgatggtgggacttgataccagagcgactatggatatggatgcaaccataaaaggcttgcctgtcaatgaacagactgtacgggaaatgtttgaagagatttgcaaaatagaattagaagatgacgtaacttttagttttcgtagcatcggagaaattcgagaaggtgatgtatataccgggtatcgtgtctctttgtctgcaaattatccgccaatggctgttccgttgaaattggatatcacgacaggggacaagattacacccaaagagatagagtatcaattcaaactcctcttagaggatagaagtatttcggtgcttgcgtataatttggaaactattatggcagaaaagctggagacagtcatatctagaggcgaccagaataccagaccaagagattactacgatatttacatattggccaagctgcaatatgcaaatatagagccggatgcgttaggggctgcactgaacgctaccacagagaagcgtggatcatcaactgtggttaaggagtaccgtagcatcatggatacggttaagagtagcgaagtaatgcagaagcagtggaagaattatcagaaggattttgagtatgcaacagacattgcgcttgaggatgcgtgtgacgtggtggtagagttgatggaaaacttaggaggagaatagcatgaaattatctgatttttcagttgtaaattacagaagtattactacggctcgcaaaataaagaccaataatatgactgtgttggtaggtaagaataatgaaggtaagtcgaatatacttcgagcacttactttagcaatggatattatgaaaatatattcaaaagatcctcgttctttgcaaatagcagtacgtccatatttaaaaaatcattattcgtgggaaaaagattatccaatatctttacaagaaaaaaatcccaatggatggtcatcaatagacttgaattttgaattagatgaacaagatattttggctattcgctctatgacaggtatacgccttagtggatgcattcctgtacgagtttcgacaaatggagcggctgcaaaaatagatattccaaaaagaggaacagcagcttttgcagatgcagataataaaaagaagattattgaatatgtatgttttaaaatagattttaattttattcctgctgtccgcacagaatatgatgcactgcgtgttgtagattctcttatagagaagtcgttagaaacattagatactaatccggattatattaatgcaatgaataaaattgaagaattgcaacaaggaattttagatggaatttcaaatcaaattattgaaccattgcaagaatttttaccgactgtcagaaatgtgcagatacatattcagaatgaaagacggcgtattgctatgcgtcgtaatacagaaattattatagatgacggaactccgacacctatacagcagaagggggatggaataaaaagtttaactgcacttgctatattaaatattccagctcgtgttgatagggtttctgtggtggcaatagaagagcctgagtcacacttacatccagagagtgcacgtcaactttatgatacgattatgtcactttctcaaacacatcaaattgtacttacaacgcatagtccgttatttgttaacagaacaaatttgaaggaaaatattatcgttaatgatggaaaagctacaccggtaaagaaaattaaagaaataagagatgttttgggaattcatatatctgataatcttacaaatgcagagcatgttttaatcgttgaaggagaagatgacaaaattgcattggaaaaattacttccaagtatgagtacaaaaataaagcgtgcaattcaaaatggaacatttattatagattatataggtggggcgggaaatcttccttacaaattatctttttatagaaatttgcaatgtaaatatcatgtattattggataatgatgatgcgggaagacatgcgggtagcgaggctgagaggcagggactgcttgatgttagaaatgttacttacgccatatgcaatggttctcctaatgccgagatagaagattgctataataaggctgtttacgaaaatgctatattgaatgaatttggtgtgaatattaatgtagccgaatttagaggaaataaaaagtggtctgacaggattgctggttgctttttatcacaagggaaattatggaatgatgctatggaaaaaagagttaaacttgttgtggcaaatgaaatttctgaagaagttgatactgtgctgaatgaacacaaaagatcaagtatggatgctcttgtaacgtcattagaaacattattatcttgatgtggatgtcgagtataagattgatgacgtaacagtgataactacgatatacttttaactgagagacgtaaaataggggcaacgttgaggtagaagtattttgaagggctgtaatgtattatactgataatcaaaccagatttttttgaatatgaacttctgataattttttattatcagaaccttatacgaaaggatggcaggtctatgaaaccggaagaacgcgcacgtgtaaaaatagataagcaattaaataatgcaggatgggagattgtatcaagaaatgagtatgtacccaatagtacattggtagtaaaagaagctattatgcgcggtaatatagagagtgactatttactattcatagaggataaggctattgcggttgtcgaagctaaaaaagaagataatccattaggggaaaatgttaaaaagcaggcggaggattatgctgttaaccctcaaccttggtatggcttgtggtttgacaatcttattcctcttgtctatatggcgaatggtaataaaatttattacaaaaatatgcttgtgccagatagtgagtatgaagaattgacagagatgcactcacctaaaaagatgttacagctaattggtaagaaatcggaatttggtgcactgccattgcttgaaaaacaaggtttaagagagtgtcagtataaagctgagataaatcttgaaaagtcattaaaaagtggaaataagaagaatcttgcaattcttgcaacgggttcgggaaagacatatttagcttgtttagcctcttatcgtatgctgaattatacagctacaaaaagagtattgtttttggtagatagaaataatcttgcaagacaaacagagagtgaatttaatttatttgataggacagaaaagcaacaatctttaagcgaattgtacaaaatcaatcgtcttagaaaagagtccgatatcaaaggggatattgttatatctacgatacaaaaattatttgctgtattaaccggtcaggcattaagtgatgataatgaagatacagaggatgaaaatgcaaaaagggcagaagaaaaagaacttgaagaagtggtgcaattaggaagtgatttaaagcttccctcagattattttcagctaatcgttgtagatgagtgccatcgttctatttatggcaaatggaaggcagtattggattatttttctggtgcaaaagtgttaggacttacagcaacaccaactccagaggcatatagctattttaataataatgttattgaaaagtatacatatgatgattctgttgtagatggtgtaaatgttccttctcgcgtgtatagaataacaacagaagttacggagcatggaggtacgattgaagcgggaacggaaattatcgaagcacctaagggaaagtcagaaactacaacatatgcagttacgaatccgattgaatatgcaccgactcaacttgatagatctgttatcaatagaaatcaaatgaaaacggttttgacggcttataagaatgcaatctataccgaattatatccagagcgagaagtaaaatgggagtatattccaaaaacgttaatctttgccaaggatgataatcatgcaacagagattgtaaatgttgcgaaggaagtgttcggaagtgaatttgagaatggtgaagttcctgaaaattatgtgaaaaaaataacttattcatctggtgattcaaatgcattgataagagattttcgtattgagaaagattttcgtattgctgttactgtaacattagtagcaaccggaacagatgttagacctttggaagttgttctttttatgaaagatgtgcaatcagatgtgctctatacacagatgaagggacgtggatgtagagtaattaaagaggataagttgaaagaggtgacgccaaatgcacatacaaaagaatgctattatattgttgatgcagttggtgtaacagaacatgaaaaatgcattccgaaacctggaaaaacacctgatggcacgcgtaagatattatccttagaaaatttgttagaacatttggcgcataatgaagtaagtgatgagaatatgatgcttcttagagattattgcgcaaccatcaatagaagatatgaggatgatgcattgtttgggcatcatttggattactttattacatcttatggatttgctccaagaacaattgcaaataatataaacaaagccttttcagaaggaattatggtggagtatataagcccatcccatgataattctatgagaatgggtattatatattgtctgattagcaatatccaggcacgaaagaaattgcttgagatgcagaaaggatatcatattgtatccccagatacagatgagttgttatacgcaggtttttcaaaagaatctgctagagattacattgataattttgaaaagtttttattagaaaataaagatagcattgaagcacttagaattatttataactctgaggatgtattaattacgcacacgatgttatgtgagttgcaggaacgtttgttagcagaaagcaagcaatatggtatttatcagatatggaaaaattacaaattacttgatacagaaagtagcgttgaagaattagatataaaatcaaatgttaatatgcttacaaacttgattcagatagttcgttttgcgtatcgtaaaaatacgaaattaacaagtctattaaacggatatgcacagcgatttagtctgtattgtggacaagctcagcgtgtgttgacagaagaacaaaaagagattatgaaactgattgcagagtatatactcaatgaaggagcgatatccattgcagagttaaatgctgtggatactgatttgtggcgtaaaggtgtcatgagttttggaattccgtcgttgtctaatgaaatgcaaacattatcaaaatttatattaaaggtggcataaagatatggcagataatatacaaacaaaaagtgaagctgcattagtaaagaaggttggagatattgcaaacgttcttgcggcagcaggtgtcggattcacggattatttaactcaacttacatatattctttttttgaagatggatgatgaaaaggaaaatcttggtcttggaagttctattccagaaggatataagtggagggatattgtggagttgaatggtacagacttggtagaaaaatatgaggaaatacttaaggaattagccaaggatgatggattgattggaaccatatttactaaagcgtcaaataaaattgaccgtccagtattgcttgctaaagtaatagaaatggtatctagtgaaaactggtatatgatggaaggcgatttgaaaggtgctatttacgaagcaattcttgaaaagaatggtcaggataaaaagagtggtgcagggcaatattttacgcctagagcattgataaaggctatggtggaagttacagatccgaaaattactgaaacggtagcagatccggcctgtggtaccggcggcttcttactggcggcatttgaacatatgaagactcaaagtaaagagatttcaaaacagaatttcttgaaaaaccatgccttgtttggtgcggataatacaccacttgtagtgacacttgcatcaatgaacttgtacttgcatgatattggaactactaagagcccgattgtatgtcaagattctttgttagatacttcggatactatgtttaatgtaatccttgcaaatcctccgtttggagtaagaccccaagggagtgtagaggtacatgcgaacagacccgaatttataaagacttcagataatcaggttaattttttacagcatattatgtctattgtaaaacctgaaggaagagttgcggttgttttaccagataatgttctgactgatggaaatgcaactgcgaaggttcgtgaaagactgttgaagggctttaatctgcatacgatacttagactgccaactggtattttttacgctggtggtgtgaagacaaatgtgttgttttttgaaaaagggaaagaaacaaaagatatttgggtatatgactatagaacaggtattaaacacactatggcaaccaagccaatgacacgagcacatcttgatgatttcgtggagtgttattgttccggtcatatgaaagataggaaacaaacatattcagaagaaaatccgaatggaagatggagaaaattcacagcggaagaggtttattcacgtgaacaattaaagcttgatttcaaatggatagatttagaagaaaaagatgatagaacagttactgaacttctttctgatatggaggataaggctactgctattgcaggggcaatttccaaactacaggagattttgggaggtattgaactgtgatagagacaaatgcattaagagagaaagtgcttgacttggctattcgtggtaagttagtgccacaggatccaaatgatgaaccatcatcggtattattggaacgtatccgtgcggaaaaacagcggatggttaaggatgggaaaatcaaagccaaagatataaagaatgatacaattatattcaaaggtgaggataatttacattatgagaagttcgctgacggtagcataaaatgtattgaagatgagataccttttgaagtgcctgaagggtgggcgtggtgtaggttgtctcaaattattatcctatattcaggacaagatttggaaccatctcgatataatgataattcaattggtataccttacattactggtgcaagtaattttgaagatggtcgtattattattaaccgctggactgattctcctaccacgcatgcaacaattgatgatttgttgttgacttgtaaaggttctggtgtcggaaaaatggtatggtgtaatattgaaaatgcacatattgctcgtcaaattatggctttaaggtgcatcgacggattgtataaaaattatcttgaaattgttatgttagcctttctatcaaaaatagtttccaaagctaacggcttgattcctggcctaagtagagatgttattttaaatatgacctttccgttaccaccatttaatgagcaaactcaaatatatcacaaatccaaagaaatattatcctatacccaacaggttgataaagaaacggaaaaactaattgatattataaatatcactaagtctaaaatcctcgaccttgccattcgtggaaaactcgtaccacagaacccgaatgatgaaccagcatctgtactattggaacgcatccgtgctgagaaagaagaactgataaaacaggggaaaatcaaacgtgataagaaagaatctatcatcttccgaggtgatgataactcttattatgagaagaacggtgaaaatatcgttaatatagcagatgaaatcccatttggtataccgaggaactggtcatttattcgtttgaaagatgtgctggaatatgaacagcccacgccttatatcgttgaatcaactgattacaaaaacgactattctataccggtattaacagcagggaaatcatttataattggttatacaaatgaaaccagtggtataaaaacagatttacctgtaattatttttgatgactttacaaccgacagtaaatatgttgattttccatttaaagtgaaatcatctgctatgaaaatactaactgcaaacgaaaagttaattaatacaaaatatgctttttacgcaatgcaatgtatagaatgtgattgctataatcataaacgttattggatttcggatttttctaataagctaatacctttgccaccattagaagaacaattgaatattgtacatacaatagaaaaactttataattatatagaaaaaagcctcaattgagacttttttctatatctcttattaaatcgaaaaaaatgtcgattttatctagaatttgacgctgttcctcataaggtggaacgggcattagcgtggttactattttctctttagaaatgttaggctgtgctccaccaacactgcgatacacaaaattgtccttttgtgatagcaaataatagaacaagtaatgattattaattccatcaagaggcgagcaagcacaacaggcttgatttgttgttgcgggaaatgttaaaataccaagtttgcctatcgtagcaccatacatcgctatcaatacagaaccagacggattcaatcttacggaagtattttttaaagcctcttcactaatagattctggtatattagtgatatatccatcgtttaaatcgcctgtttttagccaaggaattgtcccattgtagtattcaggatagcttctgcttggagtggaaccagccgcccaatctcctatgtttccaagacgacaccagctccagttatggggaatgtcgaatggtaactcttcatcaatacaaataatgtcattacctatcttctcataataagagtagtcaacacatctccgatataatattcttgcggtttattccgtaaaatctattactcggaggtgtctttttatgaagactgaacaaacttttgaagaacatttgagaaagggaaacctttcagaaaacaccatcacgtcttatctatggacagtaaattattttcatgaacattatgataagataagcaaagataatctattggcatacaagggttatcttatggagtttttcaaaccgaaaacagtaaatttacgaatacagggtatcaacaaataccttgaatatctaggaaaggaaaaacttcaacttaaagcggttaaagttcaacagaaaaactttctggaaaatgttattagtaatgcagattacaaatttctgaaaacccagttgaaaaaggacggtaatatggaatggtattttgttgtatggtatttggctgcaactggtgcacgagtgagtgaacttatacaaatcaaaattgaacatgtcgaaatagggtattttgacctttatacaaaaggtggaaagttgcgaaggctatacatacccaagatgttgagaaatgaaacacttgagtggcttaatgaagcaaatcgtacttcagggtacttgttcctgaatcgttatggtgataaaattactccacgaggaatatcacaacagctaaaaaattatgctgataaatatgggctggacaaaaaagttgtttatccgcattccttccgtcatcgctatgctaagaattttcttgaaaaattcaatgatatagcattactcgctgatcttatgggacacgaaagcatagaaactacacgtatatatcttcgtcgtacagcaagtgagcaacaagctttagttgacaaaatagtaacttggtagaattaaagccgccctcgtttgaaggcggcttttttatgatacggaggtcaaaattgaatctagttgtgcaaatactgtttctattgcttctacgatgcgatattgttcgctaagtggcggtaatggaaacagtaatttatgcaaagcgtttgatgataatccttgtattccaatacctttaccaccgataagtccagtttgcttgtataaaaagaatatataatagtagaattttactgaaattgttgtatatggtctcaagcggtgtatatgattttgaatgcgcatagggtaatcaaaacaccatatggcagatcttcctatgtcaccaccttcacacacaagcaaatcacctttcttaacagtacatttcacgacctctgaatctgtaaacaccatctcttttaaatgggtaagttcaaatctgtcccaatacatatttgatgttgtaatatattgcattttcgtgcctgacgtattagaagaatttaatgcttttccagtattatgctggaatagttcgcccaatctaacccatgaccatttatgtggaatatcaaatactatttcactatcaatgcattcgattttttttccacattgttcataataagagttatcatcacctcggaagatgatagtttctttcttatcacgtttgatttttccctgttttatcagttcttccttttcagcacggatgcgttccaatagtacagatgctggttcatcattcgggttctgcggtacgagttttccacgaatggcaaggtcgaggattttggatttaatttgttgaatatattgttcgagttcaagtttctttatttcaatgaaattattccaatataatgcttcagacaccatatttgaaatccgtacttgttcactaagcggtggtactggaataagaaaccttcccaatttagtagcatttatatttgattgattaactgcatctgtttttacaagtaaacaaatttcttttgcatacttactattcattacactattaagatattctgcatctaaaaaagaacgaattctaatcaaatatcctgcataaatggctgatacttcaccacgatatattgctgtttttccaacccattctgagctatttgttcgattgaaaagcaaatctccataagttagtaaatatttatcaatatcttctttatccgaagaataaacaaggtctgaataatcaatttctccctgttgaagattgcccatacgcaaaacagcaatttcccctcttgatgaagattttttagaagttccatagggtagatcttgagttagagaagacattcttgcccacgcccacccttcaggcacttcaaaaggtatctcatcttcaatacattttatgctaccgtcagcgaacttctcataatgtaaattatgtttaaaaaaattttatgtttttcacaccccctcaaatcatactttcgtgtgagtacttaatgaaggaaaatttttttaaactcagggtgtgcaaaacgcaattttctgtgagtaccttatgagaggaagtttttaggaacaggaacttcccgttgaaccttgacaaataacggatcagcatccgttcatagggaagcaatctgaatacaaaaattattctggaagctgattgccggtgcgccatgaggcatctgcaaagatatattttcttctgtgtctttgtaaaatggatagtaagatgtggagcgatttcaaatcggacaatagtattccgtggcaggaatgtgcgatgaacagaataatggataatgatactccttgagatagtcggcacgcagtggcggaggtgaaattcctgtgatgtctatgccaaagacagttcagattgtaccaagtacaatttgttttgacacaaaaatcagagaaagaaaaggaggtattagtggagaaacacaagaacaaaagcgttcctatttgggaaaaatcaaacctaactttaacggaggcggcagagtatttcaacatcggaaaacacaagctgcgggagattactaacaatcacaagtgcaatttcgtcctgttcattggaacgaagcggttgataaagcgaaaggaatttgaaaaatatctagagcaggttagtgtgatatagggcatattggcagttgtatgtctagataaaacgagcctcatatggtatgatatagatactgcatttggggctcgttccgtaggagaaaaggtctgttacagacttttgaaggaaaggaggccatggatgcctaacaagcgaaaggacaacaaaggcagactattaagaacgggagagagccaaagaaaagatttgacatacatgtatcgttacaccgatatgagaggtaaacgacagtgtgtctacgcagatgatttgaacaagctgcgtgaaaaggaaaagaaaatacagttagacaccttgcagggattggatatatccggtggcggcattacggtgcttgaattggtagagcgatacgttggactcagaagaaatgtgcgttacaacaccacggtagggtataattttgtactgaatattttacgcaaagaggagttcggataccaacaggtaaacaaggtcagagtggtagatgccaagagatttttactaaatctgtatgataaaggtcgaggttacagtagcatcaatagtatcaaaggggtattaaaacctgcttttcagatggctgttaatgatgattatctgaggaaaaatccatttgatttcaagatggacttgataccgaataacagtcagaagagagtggcaatgacagaggaagagcaggaacgatatctggaatatgttcgaaacgacgagcatttcagtcggtattatgatgagataatagtgttgcttggaaccgggatgcgaatcagtgaattcatggggcttaccttatcggatttggattttgaggagcgaaaaattaaggtagatcatcagctaaccagaactcggaatggtaaatactatgtggagaaaactaagacggagaatggtgttcgctttatttacatgacggatgaggtaaaggaggcattgctgaatattattgcaagtaggcagaagccacgcaaggaaatggtggtggatggttataaaggatttctactgttggacaaggatggaaagccgaaggtagcaatgcatttggagcatgtcatgaagcggttgcttgacaaatacaacgccactcatgaagaacagctaccgagaattacgccccatgtgcttcggcataccttttgtacccggatgtcagagcgtggaatgaatcctaaaacgctacaatatctcatgggacatgccgacatcacggtgactttaaatgtgtacacccacgcatcttacactaaagttgcagatgaaatggcacaaataaccgctgtttaagcgggttgcaggtacattttgtttacaccaattttacaccaaatgactgtaaaaatacgaagaattatgaagaattgtgccaagatacggtaaaaagtaatatggcagaaacatatatcaacgggaatgaataagtgcctacaaacccagataaatcaagggtttataaggaattgcaagcccttgtggaaacgaaaaagaggagaaaaaccaacatgataaaaatattattcatctgccacggcagtctataataaaatggctgaaacgtagtaaaatagggcttttgaacattttgtaattaagtttttacctatgatttacttatttcgtttttgtgcctaagtatgtataaaaaggatagaaatgagagtttgttgcagtagctacagactctctaattttatgcataaaaatgtgaaatgacagagtggttacacattctgccatttttcaaatcagtaagtagtttccgtcacttcgtatattccataaataaatccttggctattcccaccactgacaccacactttcccagcgttattgtattaaatgtaaggagggcagtaaaagaaaagcccgaaacaatagaataaaatgcaaagcgcaggagaaaaacaatatgtgtagaaaattagtagtaacaaatgaaatctttttaggaacaagagctatctgttatgaagcgtacagcttaccaaagggagaggttgtagagttaacagaaaagcagattaaggacactttaaaaggttttacaacagatagggtttatggtttgagattatcagaagcaggagagttggaacttgatacagatgactttttcacaacaaacatgatgaaaaagattcatacaaatacattagttccaatggtcgaggatgcttgtttagcaaacctattttatattgtgattggaacacataaggaaaaaggaaatacaatgtatgatgtgatttcctcacgctatgagcgaaccagtttcacagaggaaaaagtgaaaacattactcgatatgcatatcattagtgctggtgcaaaaatgcaggatggaaaagtagtggtagcgccactagaaaaaccaaaagcaccagaaccgacaaatgagtaaattatgtttcgtggggcatcattatggatgccccaatagaaattataaagttattccatgttcgcctaagattagagttagacttctacgtttttcaatgtcatctgtgcgaactaatgtaaagccttgcttttgtatttctaataaagtttctcgtgaaatatctgcccgttcacttaatgcgttgagagtatcgtcactcatgggaactttgcgaagataccaccagaaaggtaaatctatgtcgcctttttgaaatttggttgtattgataaagattgtatccttcttataagatactggaactggtacaatttccaatattttattttccatatgcttataaaattcgtctaattcattattcacaagaattttattcaaaaaaacagagggtagttttggtaaatattctttgcggatgcgtgtgttcatggaatttagcgttgtaaaataaaattgcttttcagtacttaatatcattgttaaagtgtttgaatcagggtcaaatgcatcaaaatagaggttgacagttacaccattatagtcgtatctgtatttgacacatgtacttttccctttaaatcccaattgtgagtagtcatttagtaatttggttcttacatttttttgcatagcagtcatctttcctttcttaaaataaaaaagagtacaaatcgacttgaggctcaagattttgtactctttactggttgcatatttgattaacgtatatttaacatacttgtattatattaggcattacatattttgtaaatatatgtaaaaattaaatttttctaaaattacatatatatgaacaaactatcaaaaaataatctatttgttcttcatgtattttagatattacaaagtaaattagaataaaagagcattggtttggcgtgtgtatatgaagtcaataattaagataccgactatcagaaatggtaatcggtatttttgtgtttcaatagggtatacccctgtgacttagtagggaggatatgcaaaagtatgtcaagaggctgtgatttgtatatttgaaatatttcatagaaaacagacagcttattgaaacagaacagggcaagcacgcctattttgcccatgcatcctaagtaacattgagatgaattataagaaaaattatttttttaattgtggaggaatgatagagcatggagcaggcaaaagagagcattaagcgtcaaaagaaaaaagtgtttagaaatttcattgcattaatgataggcagtttaactttactgagttctattgcaataaaatttaatttttcatatgccaagataatagttaactgcgcaataataacagtgctttgtaatcattatttgcatatgaaaatctattatctcaataaagaacttaaaaaattgcagagcaaggaggaaacaaacccatgtcactaaaatacgcctactgtagaatatctacaaaagaccagaatatagacagacaaatcatagcggtaaaacaatttgcaccagatatatcagataacaacatatttgttgataagaaaacaggcaaagattttgagcgtgagcagtatcaggaaatgaaagtcattcttgagcatatttccaaagccagcttgaaaaataaacccattgagttaattgtggaggaacttgacagacttggtagaaatgcagatttaatcaagaaagaactaatgtggtttaaagagcataatatcatagttcgtatcttggaaatacctacaacgttacatgaggtagatgagagtaatcgttgggtaacagaaatggttactaatttattgattgaggtatatgcacagttggcacaggcagaacttgagaaaagagcaaagcgacaggcagaaggaatagcaatagcaaagtcaaaaggtgtatacaagggcaggaaaccaatccaaatagacaatgagcagtttgtaataatttacaccagatggaaagcaaatgaaattacagccagacaagctatgttagaactcaacataaaagctaatactttttaccgaagagtaaaagagtatgaaaccaataaaaaagcaatcagtaacacttgaaaaattcagtaatagcatcaatgctattacatcttgaaaattttagctacattcagagggcatgataagtgattccagcaatatcaaaaaatgataagtttgtatgggtgattgaaaatctagggtaaattttttagacagacttctgaacgatagcagacagcataggtgcatttcagtaggatgcattactgttaaatagtgtggtagcataagggttaaaattttttgagtaaatttcagaagtacaaagagaccgatttttaggtagaggagaaaaagagacagagatgtatatgagaaataaaaaaaacaagataattaccattttaatgactttgatattgttggtatgtatgccagtaacagaagtttatgcaggtacatcaacaaagacttatggcacagatgcatttggagaaaccaatggttatcttcgtctatcacaaggtacgataaagagttgtaaatattctaaaaatggagcatctgcaaagactgttacaggtgataagcgttacgtaacgtattatacggatgctaatgatggaaagcatcatagaacttacacaggggattcaacctattatgaatatgtcataacagatggttatgtgtacaatggtgagaaaaaagaatgtactgtaaggatagagtacaatggtacagctagtggaacaaaagctattgaggctggttttgaagaggagtcagcaaataatggtaagccgacaggcattaccggaagtgcaggatcaactgtaaaagtaacaatagagggtttaccatctaactttaagtgtgttatggaagcgaatgacttggatagtaatgaggggtggcaagttgctaataactatagggcacaagattctgtatggattccaagtggagctggctctcatgtgagtgtaagtgatggatgtaaggctcttggattgcatgaagtaagtgcagacaatacaactggaggatgcactgaaacaggtaaacataaagcatattactacttgaaatcagatgcttcaggtaagatagtattattttacttacctgggacagctaatcatgcatcccaggttcaaggtgtatctggatcaaaagtaaaatacagtgcaaacggaaaaacagcgtcaaatattccagaagaagattattcagcttggatgtcaaaatataaaattccatctaaaaccccaactacgatgggatatacattttctcattggaatacaaaagcaaatggtagcggaacgacttattatccgaaaggttgtatagattcattacccagcggcacaacaacgctctacgcacaatggaaaataaattcttataagcagattgtaaaagtacgctatcaaaatgcagatggcacatggggcgattattcagatgtaataaatgcaaattataattatggatctacagtttcatggtcaagagcagcagatgcgacctataaagcggcaagcatttcttatactgtaacaggtgcaaattggataggttacaattaactggacagattttttaaggtcatataatctataataaatacacgaaggagcactctttatgaccgaacaaaaacaacgacgaaaacctcgcaaatatacagatgaatttaaacagcaactggtggaactatatcgttccggcaaacgcagatgtgatatctgccgtgaatatgacattgctacttccctgtttgacaagtgggtaaagcaggcatccaattccggttctttccatgaaaaagataaccggactccggagcaggaagaactgatccggcttcggaaagaaaaccagcagttaagaatggaaaatgatattttaaaacaagcggcgctgatcttaggacgaaagtaaatgtgattaaagcaaatgcccacaaatactctgtatcagcaatgtgtcgcgtcctacaggtaaacagaagcacctattattatgaagcagcagcaaaaaaagatgaatcagaactcactgcagacattcaggaaatttttagaaaaagccggaaccattatggtacacgaaagatcaagaaagaactggctgattgcgggaaacaggtatcaagacgcaggattggacggattatgaaacaggaaggtctggtatcaagctatactacagcacagtttaaaccgcaaaaagacagatgtaatgaatcaaaagtagagaatgtgttgaaccgacaatttcaaaaccagccataccgcaatgtagtggtaagtgatttgacctacgtaagggtaggaaaccgctggaattatatttgtgtactgattgatctttttaacagggagattattggatacagtgcaggagaacataaaacagcagaacttgtaaaacaggcatttatgaaagtagacggaaatctgtcggaaatccatattttccacacagaccgtggaaatgaatttaaaaacgagacaattgaagaactgttagaaacgttccatatggaacgctccctgagccataagggatgtccttatgacaatgcagtggcagaagctacgttcaagattataaaaacagaatttgtatggaatgaaacattccatacgcaggaagaactgaagataaaactatgggattatgtaaactggtataatcatcaccgcatacattcttccttagggtatcaaacgcctgtacaatatcggaaaaataacctaaaaaaatttgtctgaaaaagtgttgacaatccaaatcccagcagcacacgctaaagaatatcaccccgaacaatataacggaataaagtatgcagacccttgtatttggagtgtatcaagcgttagaaagattttagacagacaggaatatcttgggcatactgttttgagaaagtctgtcagcacgaattttaagctgcataagagaaaaagtaccgatgaagaagaacaatatgtgttttataacactcatgagcctatcatatcgcaagaactttgggacagtgttcaaaggagaaggcaacgagcaaacagaacagctgcaagaggtacacacaccaaccgattaagcggttatctatattgtgcggattgtggcagaagattgaccttacagacacattacagcaaaaaagaccgttctttgcagtattcttatcgctgtggtggatatgccagcagagtaaactcctgtacggctcattccattagtgttgataatgtagaagccttgatattgtcaacggtaaaacgcttttcaaggtttgttctgaatgatgaagaagcctttgcaaaggaactgcaagcactttggaatgataagcaagcggataagccgaaacaaaatcaatcagaactgcaacgctatcgtaagcgatatgatgaactgactgcccttattcgtggcttgtatgaaaatcttatatcgggattactgcccgaaagacagtataagcagttgatgaagcaatatgatgatgagcaggcagaattggaaacgaagatagaagcgatggaacaggaacttgccgaagaaaaagtaaataaggttgatgtgaagcattttatatcgctgatacgcaagtataaagagccgactgaaatctctgatttgatgttccacgaactcattgacaagattgttgtttatgaagcagagggcgtgggaaaagcccgaacacaaaaagttgatatttatttcaactatgttgggcaagtagatattgcctatacggaagaagaacttgccgaaataaaggcacaggaagaacagaaagaaatggagcgattggcaaaacagcgtaagcgagaaaaagcctaccgagagaaacgaaaagcgaagaaaatcgctgagaatggtggtgaaatcgttaaaaagaaagtatgtcctcattgtgggaaggaatttacccctgcaagcaaccgacagattttctgcacaaaggagtgctgcaaccaagcaagacaggacaaagtaaaagctgacagagttgcagaaaaaggcgatcactattatcgtcagcgtcaatgcgaggtgtgtggcagtatttactggcctacacacagtcagcagaaattttgttctgagaaatgcaaaaggataaaccacaataagaaaaccttggagttttaccataagaagcaaaaggagaaagcacaatgcaaagatttatcacagatgaaagaaccagtatccagtacgaactcatcggagattactactatccctgcttgatgatggaagaaccgcctactctctcaaaatacggaagaatgagagaacgatatttaagagaacacagaaaagcattctattttacgctgcttgccagtggaaagttaaatgaacaccttattcaaattgacacttcggcgtgtaatatggcggagcatctgataagagaaatagctgcaaggcaaggtgtgacggaaaagctaaagtctgaggatatgatgggatggataggattgatgaataacattcaagcctgtgtagatgaaattgtactgaatgatattgtgtattcataatgaaataccagccgaaaggaaactgctgtcaactgatggcagtttttctttttcgggaagtattcaagaagtcattaagtcgtgagtatggtcgaagcggactataagtaaaaaaaatcattctattagcctgtggaggcagaaaatctcttccattctttatgtggataaagtataatattaaaaagaattttgaatttttgaaagtgggatggaaatatgtcagagcaagaattaagaaaattacaaatctatatcagtaaaagaagtaaaggtcaaacagatgaacaagtaataaatcatatcaccaaaataaataataaaacaccgctaactcaagaggaatggcatgaattaatttttccgagttgtaataatggctatgttgaaatattgcgatttatattaagtaacattcaatgtttaaataatgttaaagaatatatgcgtcacactgtatatggtcgaaataaaaatatcaatgatgagagaatagaaattttaaaagaatttatgaaatatttaacagataataaagaagaatgtttgaacgaaacgatgatatatgctgcttggtttggagaaacaagaattgtaaaatttctgattgaaaatggtgctaataaagaatataaaactcaaaatggtttaggattattagaatgctctgaaagggttgaaaaactgtttgaagacagctctttgaaagagtttatagagaataatcaataattcaatttcatgcttgtagaactgtttttaatcataaaatcacattgaggtgacgaatatgcgatataaaaaaattgtattgagtattatagcaagtgtactttgtttagggctattaagtggctgtggtggttattctcatgattttaattcaagtgaagaagcacaaaaatatgtattagcaaaattaaaggacaaatacaatgaagaatttaccattaaagaagtgaagaagtacaaagaagaaaaaattggattgaattggattagcgtagaagtttctagtaaagaaaattcttctcaaactgctactgtatatgcacgaaatactggactttttgaggatagttatcatgtttattactattctgatgaaatagaagaacttgcaactcctttatttcaagataagtctttcataagaaattatcagcttgaagtacaagggcatacaacaacgacagaatggaatggtaaggaaagtgtaaaagaatatctgaaaaaaagagaatatgaaatagaaacaagtatatatcttaatgagggaaaaacggacgaggaatatgcagaagaaatttcctatatcatgcaggaaattgtagaaagtgatttggtttttaatatttcagtatatacaaatgatgataacattattttctattctctaccggaacagcacagtcaaccagatgtagaagcgattttagaaaaaatggaagatgtgagaagcttacaagaaacaaaagaagattacaaagaatggaaaaaacaaaatcaaaataatgaaaaagattaagaaaaaaatatcttgctttgacattaacgcataagaaacatatcagtaagtaagattgaaagaaagggtattgggaaaacggatatggcaatcattatttatatactaacgatattgttagcagttgcaacattctttattattaagaataaacgctataaagttgtaccgcttgttagttgggttattattatattttttatcggatgcgtatttatttcgatagtatctttatttgttccatatggagaaatattggtattacctttaggaagtattgtcttggggtttgtagttatcttagctgcgtttaacgatttttattctttaataagatgtaaagataagatagaaggtatttatcgtggctataacacctattacggaggaaatggagtttctacccaagcacctgtttttgaatatatgtataatggaatacagtatcacgaacagacaacacaaaatatctcatataagcttttaacgcaaaatatgagggatggagatacttacagtatctatgttgatccgaaacatccagcagtgttcattcttcaaaaaaagattaaagtgagtgctataattacagttgtatttggaattatatttttttcaagtggcattgctacactatgtgcaattttccctatattttggagtgtgattaaatgatttatgaaccagaaaatctaaaaaataaaagaacgatgtatgagaaaaaggctaaaatgcttgttactattgaatttttcttatgggctgtaattttatttgtttatgtaaacatagtaattccttatgtgggatcaacaatcggctttttaactattataattggaggaattgctataattacagctttttatttttttattgccttttatgttctaataaacagaggacatcgctttagaaaaataaataatgctattgtaagagaatataatgagaataaaaacggagaacttttcttagaaaaattatttgcaatagaagaaaaagctacagatatgaatgatgaaataacttggtatcttaatattgcaaccgcatttagcgtattaggtaagaaaaatgaaagtatttctttattgaaacaattagaggaagttacaacaggaggagataaagaacttattcaaaagagtattgaatttatacaagggcaaatggaaaatgaatgttaagtataagtttgttcaaatagttttatttctatactcttaaagcagttagtctgtaaacgcaaaatttgcgtttacgttagtcttaggattagctgcttttttattcctataacttaatacataaccacaggttagtacaaataccttgtgagatttttgaaaggcttagaatgggatatatgccctatttacgccccgagaaatgacacaaacaaggcttagtatctttccctgtggttttttattttcaccacgaaaggaggtggtctgccccaaaatgagaatgtgcatgaacaagagtgggtgttgtttctgcataagtgaacttgtgttacccacaaatttaattgaaaaggagaacgaaaaattatgaaacaaacggaaaatgaaatgaatgtaagtgtacctcttgaagttatcaaggcaagtgaaattgaaccaaaagaagtaaaatggctttggtatccgtatatcccttttggtaaagttacacttttgcagggtgatcctggtgatggtaaaagtaagctaatgctttcaatcgctgccctactctcaaaaggagacccacttccctttactgacacagacgaaacagagcctatgacgattatctatcagacaacggaagatgatgccgatgatacagtagtccctcgtttcaatgctgctggtgggattggagaaaaccttatctttatcaaggaagatgtaaagtccttgtcttttggagataaccgcattgctgaagcaatcgaaaagtatcacgcaaaacttttaattcttgacccgatgagttcctatattggcgaagattgctcaatgaataatgctaacgaaacacgagcagagtttaatcatctaattgctgttgcgaaagatactggctgtgcgattgtgattatcgctcatatgaacaagatgaaagataccaacccgctatatcgcacgaatggttcgattgatattgcaggagcagtaagaagcattattgcaatcacacgcacaccgaacaaagaagcaccatcagaaagatatatggttcaagtaaaatcaaaccttgccccaacaggttcagcaattctatttgaagttgcagaaaaaggagtgaactttatctctgaaatggaaatgacagcagagcaagcatttcagtcccttgcccctaaaatgggtagaccaaacgaaaaggaagtaaaggcaacagaaatgatcttggaaatgctgaaagatggcgaaatgcttacttcggaatgtgaggaaaaattagaagccgcagggttcaagaaatcgaccattaaaaaggcaaagatgaaagctggtgctctttcaaaaaaggtaggctttcaatggtactggtacttgccggtgggcgataatccgaacgaataaaagtagactgtctgctgatgggacggtctatttttgtgagagaggtatcaaaggaggtcaagggggaacacccttgcccacgacatctttgcagacgaagtctgaaagtgtcatagtgggttacacacattcaaagaatgttgtgtaatggcttcgccctgctgagaaaggagagtcaaaatggcgaaaaacagtaaggcagatatgagttgtgcaagagtaaaaaagtatacttcttcagatgtaagcaaagcagaaaggcataacgaacgcaagaatgaaacctatgaaaatatgaatgtgattgcagaacgaataccctataatgtgcattttaaagaaccgacttctccaacctatatggaacaattaaagcagatggaacaggacggaaaagtatcgcttcgaggattgagaaaagacgctaccctttttaatgagattgtgattgatgtgaacacgatgtattttgagcgtaatggtggctatgaatatgcaaagcagttctatgaagaagcatttcattttatcgaagaaaaatttggtgcagataatgttatatcggcagttatgcacgctgatgaaatcaatttggcagcaaccgaggacttaggaaaagaagtttatcactatcatcttcacgctatggttttgccagtggtagaaaaagaaatcttgtggagcaagcgttgtaaagaccccgaactaagaggaacagttaaagaagtagtcaatcagatcagccactcaaagaaatggaaatcagacattccactggttgatgaaaaaggcaatccactcttacgaaagaatggaaagccgatgtttcgagcgtcatacagcatactgcaagatgagttgttcaaccatatgacagagaaagggttcaaaggttttcagcgtggagaatacggaagtacagccgaacacctaacttccctgcaatatcaaatcaaacaagatacacagcgtttagataagttgcagcagcgtattcaaaaggagcaagtgaaatataaatcatctcatcaaatcttcaaaacctataatgagattgatagtatgggacagaaaacctttaccggcaaaatggcaatatccaaagaagattataaagaactgaccacacttgcaaaggagggtatcacgagccgagcagaaattaaaaagctggaggaggatgtcggttattatcaacaacgctattacaacactgccaacgcacttgaaaatatgaaaagcagatacaacgaactgaaagaaaaatgcagaccatttcttcaagcgttggagcatttccccgaagttgctaaactttttacagaaaaagtgatggattgtcaacactttttcagacaaatttttttaggttatttttccgatattgtacaggcgtttgataccctaaggaagaatgtatgcggtgatgattataccagtttacataatcccatagttttatcttcagttcttccagcgtatggaatgtttcattccatacaaattctgtttttataatcttgaacgtagcttctgccactgcattgtcataaggacatcccttatggctcagggagcgttccatatggaacgtttctaacagttcttcaattgtctcgtttttaaattcatttccacggtctgtgtggaaaatatggatttccgacagatttccgtctactttcataaatgcctgttttacaagttctgctgttttatgttctcctgcactgtatccaataatctccctgttaaaaagatcaatcagtacacagatataattccagcggtttcctacccttacgtaggtcaaatcacttaccactacattgcggtatggctggttttgaaattgtcggttcaacacattctctacttttgattcattacatctgtctttttgcggtttaaactgtgctgtagtatagcttgataccagaccttcctgtttcataatccgtccaatcctgcgtcttgatacctgtttcccgcaatcagccagttctttcttgatctttcgtgtaccataatggttccggctttttctaaaaatttcctgaatgtctgcagtgagttttgattcatctttttttgctgcttcataataataggtgcttctgtttacctgtaggacgcggcacattgctgatacagagtatttgtgggcatttgctttgatcacatttactttcgtcctaagatcagcgccgcttgttttaaaatatcattttccattcttaactgctggttttctttccgaagccggatcagttcttcctgctccggagtccggttatctttttcatggaaagaaccggaattggatgcctgctttacccacttgtcaaacagggaagtagcaatgtcatattcacggcagatatcacatctgcgtttgccggaacgatatagttccaccagttgctgtttaaattcatctgtatatttgcgaggttttcgtcgttgtttttgttcggtcataaagagtgctccttcgtgtatttattatagattatatgaccttaaaaaatctgtccagttaattgtaacctatccatgaagcagcttttttcttttaaggaagtacaggaacgagccgaaaaagaagcaatggaaaaagaaagacaggagcgtatcaagttacgaagaaagaaacgagatatggaaagataattctttgataatgatgggggcagtcagataaaaactgattgtccttatctaataaggatagaaaacacaggtggagtatggtagaataagaataactaatcagaatttgaagggatgcgtttcaagtgacaaaggaagaacgacaaaaatataaggaactaacaaaagcgttgcctaaaatattaaaagataaaattaaaaaatataagtttaagaaaaaagactttatgatttggtataacaaaaaagaattatttttcgatttgctcattgatgtgaaagtaaagtcagatgataagtgttattgtactgccgtagaaacaatcaaaccattgtggttagatgatttgttatgggatttattgaaaatggaaaccaacaaagaagcacctttaagtttgagaactattggtgcatttacagttagtggatctgaattatttaaaaatgaaacagaattaaaagaatggacaatcagtgaattagaagaaatcatagataattatttagaacatttttataaaactgttcaatcatcttcaatctgtgatttttacaataatttagaaaattctatataccatgttgaattaagaaaagcattatcattgatttacgagcataaatgtcaagatgctttagattatttgaaagacaaagatgagggcatttttaaaaatggtaatgtgtctataaataatgcaatcagagaatactgtataaatcaactttctaattgataactaagatgcaagaaaagtgttattcacagaattctattacacgagtataaatggataaatcccaattttgatacctacaattctttaacacctaactggtattataaagtgttacgataaaatccgcaatgccttgattttactacagttttggcaagtgagctttcccttagactttcccttatgttatatccttttcccttgtgttacgacacctcataagggcaaaaacaagggaagcaaaatccggtaacagctaataacattatataaatcacataatcggctggaactggtcaagatgcttctacaactgaaacagataagagaaaggactttgcaatatgaatatcgttcatgcagaatataataaatatcacaacatcatagacatcaattattacaatggctacatacttcggattgactgtggcaaggcagaagatggattgattactactcctaactctcaacgaatgttggatgcactggcgattgacaatccactagaatatgcccgtttgtatcttgattcagaaatgcaagattgggtgaatgcgatgaatatggaatggtatagcacttgataaaagaacataaaaatgagaagaaatctgtcaaaagtatttctataaaatacgatatttctttagcccttccataaataatgaaatagagccgataactcacaatcgaaataacgagtgattcatcggctctatattttatggttatggatatcatgagtatcgctttatatgcaattgctattttgttaattcccaatatttatgacccataaagaagattgttaattcgttttgatctacttctatctcaaaattcacgctattatctctctgttccacaaaaatcatatttgaggaagatatgctatataatgcattgccacaggtaatacccaattcgggcatatctttgtttacaacaagtcctccattttcttgaaaggtaaacacttcctctgcatttgcattcttccatgtaccaataatattttttttattctgaatgtgctttatttttccaacacatacaacgataagtatagctacacttacaattaaagcaatgcctacaacactctttgccaatttctttttattcaatttctattatctccatttttagtttctttaagattgaatgattccatattgcttaattcagtatctccatgaatttctaacattgatacgcttctcacaggaaatagaataggagagattcattcataaataattaaatcattcatacttacctgaatttgtaatgtttttccatattttctcataattatctactatagttttttctgaggtcaaaaatgcaaacatagatatacttgaatagagagtttccgccgaatcaaaaaccacacaactttcatcatgagttagatttctctttgaatatatttccgatacaggcataaatgaattttcttcctctttggtgtatttatacccatcaatacatcctagattttttaaaaatattaaataagtatcttcggtcttcagatattgccatccgttagtgtaaaattcttcacctctaacaaatgatacaggttctataatgtaaatacagtcacctactgaaagattagcagaattatccttatagatttcctctatttttaccattgtttttgttgatcgtaaactcatttcacgagaatttgttacagttatacgagctattaaagaagaatctttttccatatcatccaatgagtaattactttcattgttaaagtaagaagttttctgccctcctgtatagaaaatttccatagctgtattttctgataaagcaatatcaggatcatgaacccctgtagttgtttttatcccagtctttccatagaataaggctgtcaccatacaaatgattacaacacagatagttaatacaaatttcttcattacatcaactccttaattttaccaaattccatgcatatcttctcatccgctaatatttcaatatcttctttattatggcttgtcagtatagtaatggtatcattctttttttcttccaatatacgttcacgaaataaatcaatgctatgctgatccaatgcgttagttggctcatccaaaagcaaaatttttggatgttccatcagtgcttgacaaagagctagtttttgacgcattcctaatgaatatttatttacttttttctttgatttgggatcaagaccaaagtatatcattatttcatatatttcttcatctgatacaattccttttatattggaaagcattttcaaattttcaaatcctgaatacatactccaaaaagaaatattttcaataacagctcctaaatctggtaaaacatccatatctttatgtaatgccttgtgattatattttatgtatcctttgtctgtatttataaaacctgcaatggctctgagtagcattgttttacctgaaccatttttaccatatattccatatattttaccagattcaaatgtataactgatatcatcaagcactttttcacctttaattgactttgaaatagattttacatataaattcatggatatcattcacctcacaatatttgttttttttcgcaaagaaatttacctatccacaccaaaacagcggatgatataactgaaatgagacagcttgacttaaaattcaataaatctatattgcttgtagtccattcgtaattttcttcgacataatatataataagcttgttatgccaattaaataaaggaatatgtagcaaggaataatgccaaattttccatataacatttcccattgaaaaataaaatccacacaccattactggaataaaaaatacaataaatgcaacgatgtatcctataattgaatctttccaaaatgaaaacaaataactaatcatttgcaaatgaaaaatctctatcaatagcataaaaataactttgaaatcttctaagccattagaggtatgctctacaaaaagaaaaaacaaataatcggaaacaactacaatacagtcacgtaatatcatttttattaatatatccttataaattatgtgttttttcccataacgaggaagtagaattaccatgttatcatttgcatcattaaataagtccattgtaagataacaaatctcaaggataaacaaaatcgcaaaaaatgataaagatataaggtcaaacgaatgatctattagtattcccccaaaatatatttgtgaacgtactccttctgttattgtaaccagactattatgaaaccccaagtacacattagcataaaaatatctaattacaaatgttataagtgatactagtaagcattttccaacattaacattcaaaatttttttcttatataacttcataattttttatttttctctgtataatgccaatacttaatccaaaaataagcaatatcagaacaatttctcctattatatttccatgaacattaggcataatataaccttgtatagagaattcatttagcccaaagacagaaacaatcaaattaaaaacaatatagaatataaacaaagcaccaggtatctttgcgaaatatagaactttcattttgttataatatgaaagagcataagctaagatagctaatcccgagccaaaaattccgtaattaaaaatgtatattagattatataaagttggatgttgcaatctcaccatatcaagaaaattgtcagcgttatatgataccaaacctatagcgtaatcaggttctccccaagcactgtcatatccatgtattggatatgtcaagtggcataataataaatttatgagcattggtattgttattgtcaaaaaggttacaatcagaatgccaaataattttcctgctaaatatttctttttcccgattctttgaataagtaggattgaactattgcttttttcttctcttattaaggaaagtgatgcaataattgttgcataaacaggcaataacagatacattatatatggaatatatgccgcttcagtgccctgtaatacgaaattttcatttgctgaacgaataaattgataactttttcctatatcattttttacacataaaatatacgaagcaatatttaaaatcattagagcaataaaaacaactttatattctgcacgatcaatacaatgtttgatttctataagaaccatttttttcataatctttaccaaaagggcataaacccacgaagaggtttatgcccatcccttctgttatctaaaatctacatttccacttacaaatgcagttgataattgagattgataattttccattcccataccgacctgtgtgttagtagaattataaccgctcttggtaaagattaaattacaagatcctgttccaacaccctgcttatacttattagatattttactcttgctgttattgacagcccagaaatttgcgtaagaggtattggtaattgctgttacctcatttgtgatgtaatcatcggatgttgtttttgcatgcatagaggtaaagttattagtcttattcagtttaagtgcataagcggtgtaagatgccgcctgagaatatgctgctgaagaaagaaatacacatcctgcacaaaacaaaccaatacctacttttgcaatcttctgttttaaactttttaacatcatagtcaattcctcccaatcttatttttttaactgcgttggtacttttggttcatacaacaaaccacggcacaatgaatttgcattacttcgagcaatagcagtcactgcctgaagtacgagacgggcacttttctggggtgccttgtttacttgcttattgtccatcgttttcacccccccccctccttaattgtctgacaattacagacaactttatttgtttaccatggtatgtgcttaatataacagagtatttaattttttcaatccctctatgcacgaatggtagcccaacatgcacgaactgttctacatataggtataaaaccgaaaagatggcagataggttaagcacctacctgccatctttaatctatatatttcagaaataatgattaattattgtcagtctcatatatagatttataacgctctcgatcaactggaataatctcattatcattagcatctttatatgtaataaactcatcgtattctgtaactgatttttcctctgagacagaattaatagaatacatattcgaatcgttacacattacatttgaatttggaccagaaattagtaacgaaccatcctcttgtgcatatgccaaaaagatataaatggaattttcggaaggcagtgaatcattctcaaacagataaatagcatcttgtttttctgaaattccgccttgtttaacaataggaataggtttatctgtaataagttcaccttttatattttcgagaacctgaatagtataattagtgtaaggcgaaccgacctccttaggatttcctttttcatcttcagtcgttataacatttcgatactcggttccatcgcaactgacaacctttgctacaaatacgtaatcacagataccaacagcttcgcgaatgttatcagtatcatatacaaaagatgcgtgcatctggtggattggcaagttagatacatttgtattcagttgacttgcattatttttggatgcacatcctgtaaaaaacattcctacgataagaacaatagacaaaataccatagatacttgattttttcatagcgttctccctcccctaataattattatatgcggcatcatatgaatctttatcattttgagataatgcctgcgtactagtatgtcccgtaattgctgcatccataacatctgttgaagtactgtgatccaaccctaatgcatgtcccaattcatgtgtcgctacattctgttttttactattactataaccgctcatataataggtattgagttcaattttaccactagaatatgtcatgcctgcccatccattcgaagcattgacatcgcttacgtatacatctggtgctagaatataaatagtacaagtcaaaatgagaattccttataagaaaaatcatggtacaatgtaggtaccgcactgaaggaggatctcattatggcaaagcactatgacaaacaatttaagctggatgcagtccagtattatcatgatcacaagaacttaggactgcaaggctgtgctacaaacttaggaatcagtcagcagacattatcacgctggcagaaagaactgcgtgaaacaggtgatattgaaagccgtggttccggtaactatgcttctgatgaagcaaaagaaatcgcacgattaaaacgagaattacgagatgcacaggatgcccttgaagtattaaaaaaagcaatcaacattctgggaaaatgacggaagccatttatctcgaagttaaggagatggcagaaactgcccataaggcaaaacgccgggtttctgtctccggaatgttgaaacatcttggcgtttctcgttctggttatcatgcatggctaaaacgtgttccttctaatacagaaaaaagacgtgaagccgtaaaagctaaaattcaggatatttacgatgaatcaaaacagaattatggtgcccctaaaatcaccaaagaattacgtaaatcaggagaaatcatctctgaacgtaccgttggtaagtatatgaagcaaatgggcatcaaagctcaatgggtcaagccatggaccatcacaaccaaagattctgacttcagcagcgaattaaaaaatatccttgatgaacagtttaacccagaacgaccaaatgctgtttggtgttctgatattacttatatctggacgatagacggatttgtttatctgaccagtattatggacttatattccagaaaaatcattgcctggacactttctaaaacattagaagtatcctgcgtgattgaaacaataaaaaaagcaaaagcaagacgcaatatcgatgagcctttgattctacattcagatcgtggcagccagtatgtatcaaaagaatacaaacgtgtaaccgcaaccatgcagtgtagttattctaaaaaggcatatccatgggataacgcatgtattgagtcgttccattccctgattaagagagaatggctgaatcggtttaagattcgagattatgagcatgcatatcgtttgattttcgagtatttagaagcattctacaatacaaaacgaattcatagtcactgtgattatatgtctccaaacgattatgaagagctgtatcgtaggcttcaacaaggcgaattgcagatggcaggttaagatgaggaaaacctcattttaacttgtactaaatcttgacataggaccaatcttctacaacaaaagcactgtcttttctgattactccagatttatatgcattccatgtggcagccccagtgttaatataactcatgtaagtgctgtttccgtcatagtctagatgtttgccagaatcaacaagatcccatgtttgtacataagcttgtgcaaatgccgtaataggaaatagcattgctatagccattaaagttataatgctatacaataaatgattttttaaaacagattttttaaaatgcatactccttcactccttttcaatcatgtaacaacggttatcttcaattattcttaaaggttatctttatgaaaattgaaacgcaacacatactagtacacattatatatcctgttaatattcctaaagtacgacatcttatcatctccactccatattatagattctcagaatacttaagatgtagtagtataccttgaatataacaaaatctttatacttttcaatacctctatgcatgaatggtagctcactatgcacaaacggtagcatattatgttgtgtacctactttattgatgataaaatatgacggagaatgattaaaggaagtggtagctatgctatatattgactcaatatgggaatatattgttaatttcttagaactggcattgtttataatatttatccataaaaaattgcgtattcgagcaaattataaacatcaagcagttttgatgtttcttttcgtatcatttcagtttgctgtgttatgcacgctgaataaaatgggaatatcatcctacagcactttgatgtcatcttgtgttttggacattggatatgcagtattgttctatcgtgatagtataattcgccgtatcttttggggcttttcgtattccatcatttgcttagttgcagaacagatttcgttctttattcccgttactctttataaaggagcgtctctggagctattattaggtggaacattacggaagccatataccatgttatatttggcaatgatagctgtttttgtcttgttatttcattctattggaaacaaagacatatctctttcaccgttccaaaaagttgcatatattttcatcgcaatttctggacttgcaatcgggcactacatattaaggctgactttggaatctgttgataaatttggtgattcatccttttcagctaggctatcattggttgacttgttttttattattttatttttagtattgatgctatacatataccagctaggttattcaaaagaagaaaacatacgattactggaagaacaaaagatttatgagctggaaaggactgagttcaatagcttatctgagacaactgaacgattacgaaaaatgaaacatgatatgcagatttatgtggatgcaatcaacgtattagcaaaagacaagaaatgggatgaacttatagcatatacagagcaataccataacactcttgcaactacgcaaagtgccatagcaacgggaaatattgctattgactgcatacttaccgcaaaacttgattatgctgaaaaacacggaattaagacagaatattctattatggctcctgaaaattttccgcttgattctgttgagctttcatccatacttggaaatatatggaataattccattgaagcaggagaaagacttataatctctgatccaaccgagcatccatacatttatttttatattaaaccttaccagaatatgatactgattcacattgaaaataattatgatggtgtgataaaaggtagcattgatggagacattttgagtgttaaacaaggaaacgaacatggacttgggataagacgagtaaaagagcttgtagaaaaggcagatggcgtattgcagattacatctgataacaaaattttttccgtacatattatgataccggataaggagaataacaaactactatgaaaatgaaaataacaatacttgaagattctgtgatcgaatcagaacggctgaaaaatggaataagaaaatacgggcagcaatatgattgggatattgaaattgacgaatacgaatcgggcgaagaatatttttcaaaaaattctgaaggcacaactatacaggcttcagcatttttccttgacatacaaatggggcaaatgaatggaattgaggttgctaaacgccttcgtgaatctggttatcaaggtattattgtatttttaacagcttttagagaatatgtattccgaggatatgaagtcagagctttaaactacttgctaaaacccgtcaaggaaaatactctttttctgtgtttggatgaaatcgcgaaggagttatctaataatacctacatataccgaaacaagcaggaaattgtaagtattccctatgcagatatattgacattttcgagcagattacattatgtggatatattgaccgtagacggcaaatgctatgaacaaatgtctaccctaaataagattattgtccatttgccaagtgaatttatccgaacccatcgttcttatattgtaaatatggcacatatctatcgtattacatcaggaacgattgaattgtcaaatcatctaactacacaaatcgcacgttcttattccaaagacgtgataagtgcttttgccaaatatacaacaagatttgatacaagcggggattttgaatgattacgaagtgggctacatctattgctaataagttagcagaactatccggggaggatgtttctgcggatcaattagaaatatacatatatggcttagaatgttttttgaatacttttataaccatagtgttattgttcgtatggggagttttatcacatacactcggctataccctaatttgggtaattaccttttcattgttacgacattataccggaggtgcccatgctccaacgcagttaacatgtatcttaggcagcttttttctcggttgtcttgataagtgggctataatctatttaaagccaactgtactaggatatttgatacttgtccttatgtgtatattatttgcacctataagtaaccataaaatatgtttaaccaccaaacaaaaatggatacataaacttatttctgtgataattgttagcattggatttctgctgttttataaaattggaaacacgaagatgaataccacattgttttattcctttttctgcgtaatcattcttatgatagtcgaaacaattaaaaatctaatgagacactttaaatagcaggatgacttttcataaatattcaaaaaagataaagaatttgatggtctttatcttttttgaatttaattagattatctagctcctctgtctgatggcgaacgatagttaaaatctctgtcctgttcccgtttctgaacttctgcctgtttttctgccagctttcgatggattgagttttctccatacttggagttccattccttgtttgctttgacataggattcatactcggacttgccttgtttatagacttgcaggaacgcatctaccgttggatatttgtaatcctgcacgatatgggataatccctgcttcataatcttaatcgtttctgcgtatttgttagactgtgcctgcaattcctttcgtttctttccttggaataatcctgtacagttcttcaaatcctcgtcaataaggtcttttttcacttcctgcgtatgaatggctctgttttgtcgtttaagtttctccataatctcttcaagtcgcatctcataatcgtgtgccagctcagacattcttggtcttggcggaataacggtcttttctgcggtagtagtagcaggtgctttgaatggttgggtcacagcaggaattgtctgattgtctgtctgtgtaacggatggagctggttgtttctcttgtttttcatttcttcgctccataaggtcggagattctggctttctgttgttcctgtttctgtatcagcaactttatgagttcttttaacagctcgattgcccgaaagataatcataaacaaaagctccggatgattgccatacttgtgaatggattccttaatcggagttgaaatctgttcctgctttacctttaagatttcctttcgctccatccccgataccaaagcgtgatccacagtacgattccagtcctgtatgaccttattattgagtgtaatcttatctgcctttggattgttcttaccgattttcttagtggcaagatagacatccccacgcttgaatgcagacagcttttctttctcatctttgacaagtccgttgatgacatcggtataaaataccttgacctcatctaagaaatgttcctgcttaaagcgagcgtccttgatggtaaacatctgtctttcgtagacctcacctttcttgatcaccttacaccttttacggatagttccattctcgtctaggatttctttcttggtacgaacatgattacctttctcatcatagaacatatttctggtggcaatcttttctatcggttcgtcaagataatttcgttctgcaaagataagatggatatgataattcgtctttcgtttgttatgatggagtgctgcaatacaatcaacaccataccgacttttgaatttatccgtcatatattttaatagtccgtctggcggataatccacaaaggattccggcagggcaatgataaattctcttgcttcgatacattttccctctgtaccgcttttcttaaattctgcctgattgcacttggcaagttctgtccaaaattttcggtctgtggtttcatataccgcatagagattttcctgttttttgtcactggagatataatagattcttccacgaacattatggagctttgacatctgcacaaatgaatttcttggcatagcgatttcctcctttcccagttttgattttggaaaagaggacagataagatagatgagatgtgagtagtaaactttccctgtgagcgagtgcataggcactcgtcttgcgaacacatccgccttgtggcggctaagcctcgcagagcgaaatacacagagtacaaaacgaagttttgtgcgatgggtgtatttcgctctcaaacgccgagggcttgcttatgaagttcacttttagctgtaactgttccctcagcacctaattttgtgcctttaatggcacactttttatgtgccgtatccggcactcccttttcttaacagaaatgctagaagattgctatgaaaatcagcgaaacaatagacgaatccgttagcacttttgccttaacaatagcattgttctattattcagactttttagcaaaaaccgtagaaacagtagaagtctgctattaaaatcgaaaaaacaatagcacgattcgttagcatttttgccctgacaatagcattgtgttacttcgcttacttttaaactgtgtctggcaaggaagtggtagtaaaagttcctattaaatttcatttttaatagtgcattgttttattacattttgattttaatagagctttttactattaactctttgaaaatgtaccccatagattggacactcaaaatcatagtagcgtacactttttgtcataggtcggacagcttttttcatagctacacttggtatgacttctcacagcactttttgtaagttgggtggacttgtcctaccagtcggcttcacttgggtggatggttgcacccacttcattttctggcttgggtggactattcataacaccttttgcatcttgggtggacttgtcctaccaacaagctataactgggtggacgattgcacccattcacatccatcttgtcctcattttccaaaagttctggttgtatctgaggacttgtccgtgatataatctatttgcgtgtaggtatatcatggcttttagtcagatacataccagagggatggtcttaggactgtcccttattcatttttcattgttcccttgaccgcttttactgcgtgtctgtctcgtaaatccttcccctcattgagaatcagaaactcgtctaatcgttccctgcggattaagatttttcttcccactctaaggataggcagcttttcccattccacaagatttctaagagtgtttcttccgatacctgtatagtcggcagcttcttcaatggagagagcaaactttaattctgtcattcgatcacctcattcctgcgtaggattacaagtcttgtatatcagaggatgttcctttttgaagaaaggattagccttttttaaaacttgcgttacgcaattctgattaaagtatatatcttttataacgctatgtcaagccttacgaaattctatcatcttttatagaattgcgtattgcaatatatcgtgttatgtggtatagtaatgacataccgaaaaaggaggttcgcaagtatgttaaaagataaagaattgcgaaagacaatcggtagcagagcaaaaagccgtagacaggagttaggattgaaccagccttatgtcgctgaaaaaatgggcgtgacagcctcaaccattcagagatacgaagcaggaacgattgataacaccaagaaaatgaccttagaaggtctggcagatgcacttcatgtatctgtggaatggctgaaaggtgagacggacgaatacgaaacagacattacggataaaagagaattacagattcgtgatgtgatgacttccattctgaataagctcccttatgatatggaacagtccgaaagtgatttttccaaagacctgctactactgatgttacgggaatacgagctgttcgtggattcgttccagttcgcttgtaagaatttcaaaggaaatacagataacaaaatgctcgcccagacaatggggtttgaatccaataaggaatacaatgagattatgttccttagagaaatcacccacaccgtcaacgcattgaacgatatgggcgatattgtaagactgtattctaagaatcctgagacagcgaaaaatcgactagccaatcttttatcagaaaaagatcccgattcggtatagataggcagacggagctatgatatacttacacgcaagaagcatttcaccagttccgattgccgatatcgaaaggagaaacgattatggcaaaaggttctgtaaggaagaaaggcaagaaatggtactaccgcttttatgtggaggatgcaagtggtaacttggttcagaaagaatttgcaggtacggagagcaaatcagagacagagaaaatgttacgcaaggctatggaggattatgacgcaaagaaatttctagccaaagcggacaacctcacactcggacagatgctagatgtatgggcagaggaagatttgaaaacgggttcacttagcaacggtacagtcggtaactatttacaggcagtaaacaggattaaacaacacccaatcggaaacagaaaactaaagacagtcacttcggagcatttgcagaagtttatggatttacttgcatttggcggtgaggaaggaaattttaagtcaaagggttacaccatcgactatatccgttctttccacgcagtcctgcaacagtccttccgatttgcagtctttccaaagcagtacatcacattcaatccaatgcagtatgtggtaatgcgtaggaaagccgaggaagatgtggatttgttttctgataatgatgaggatgcagaggttatcaacccgattacaccagagcagtatcaaacgcttatggagtatctggaagaaagaaacaagcctgctgtcctgccggtacagatagcgtactacacaggtcttagacttggagaggtatgcggactgtcttggagtgacattaactttgaggaacagtatctgacagtacgaagaagtgtccgttacaacggagcaaggcacaagaccgagattggtccgacaaagcgaaagaaagtccgtatcgtggatttctgtgatacgctcgctgacatcttaaagaaagcgaaaaaggaacagagaaagcaggtattcagttacggagaactctatcagaggaactactacagggaagttaaggaaaagaatcgtatctactatgagctttatcatttggatggcacagaggacattccgcttgattacaacgagattgaccttgtatgtatcagaccggacggagcatacgaagcccctgcaacggttgagacagctttaaggacagcaaggaaacgattgtcggagcttgatgataatttccacttccacaccctgcgacacacttataccacaaacctgctctcaaatggagcagcaccaaaggatgtacaggaattacttggacactcggatgtaagtaccactatgaatgtctatgcacacgctaaccgagaaggtaagcgaaactcagcccgactacttgataaggtggttggagaataaaatcgaataagaaaaactttcccttgtagatacctcataagggcaaaaacaagggaaaaggatacatatagagtggcaaggcataccgccaagtcgcataaaataaggaaagttgagattttagttatacaaatcgaaatttgtagaacttaataacaaataaataattgctactcttaaagtagtatcactgagcaggaaagccgtaaaaaggtcttcctgcttttcttatgtctaaatctctaaatagaaaatcattttagtccgcttcgattatattcacgacttaatgacttcttgatatgttcaaatgaaatgtaatgattttgtaggcgttctaagtgaaataccctgcaatctaaataaaaaaaggaggatcaagctatatgaaagagcataattgttcttattcaacacgaataggaaaaacaacttttattgtaaatgtgaaacaatcagaaactgcccaaaagcctttgaatacagtgtttcaagagatttgtaagcacgaagtattggaagattgttcggcagataaatcatcaattttagaaaaccacaaaaaatcatcttgacaaagtcaatcccgaaggaactggataccgtgcaaagacaagatttgcgaagtttttcaatctgccggagctgattgcacttttcaaagagagtgcggacattcagacaccggatatgttaaaacttcctgtgccggaagcagaatatgaaaatgtggttctaaagccgagcgagttccagaaagatatggtagcgtctctagcggaacgtgccgaagcagtccgtgacagacaggtgcagccttatgaggataacatgttaaagattacgaacgatgggcgaaaactggcacttgaccagaggctgctcaatgatatgctgccggatgaggaaaattccaaagcggcaacctgtgtggagaaagcctatgagatatgggagaacaccaaagagcagaagtcagcacagttgattttctgtgatttatcgacaccgaagggcgatggcacttttaatgtgtatgaggatataaaaaataagctcatggaaaaaggagtgccggagaatgagatagcatttatccatgatgccaatacagaacttagaaaagcggagctgtttgcaaaagtaagaagcggacaggttcgttttttattaggttccaccgccaaaatgggagccggtacgaatgtgcaggacagactgattgcattgcatcatctggatgtgccttggcgtccttctgatattgaacagcaggagggaagaatcttacgacagggcaaccagaatgataaggtcaagatatttcgttatgttacggaaggtacatttgacagttactcatggcagctcattgagaataagcagaaattcatcggacagattatgaccagtaaatctccggtacgaagctgtgaggatgtggatgaagcggcactttcctatgcagaggtcaaggcacttgcaacaggtaatccttacataaaagaaaaaatggatctcgatattcaggtatcgaagctgaaactaatgaaggcaaaccataccagtcagaagtacaggctggaggataacatcacacagcattatccgcatcagatcgctattttcaaggaacgtatcgaaggttttaccgctgatatggaaaaatatgcgaaaaataagccggaggataaggaacaatttttcatgcaggtgggaggaaagccttatacagataaaaaggaagcaggaactgcgatcatagccatgtgtaaggaaatcaaaggcatcaatgccagtgcggatgtaggggaatatcttggatttaagctgaatgtaacctttgattctttcaacaataaatttgtaatgaatgtcaaaggagccatgagccatccgatggaagtcggcactgatccgctcggcaatatcacccgtatcaacaatgcgttggaagcaatgccggcacagcttgaagaggcacagacgaaactttccaatgtggaacatcagcttgaaacagcaaaagcagaagtagacaagccgtttccgcaggaagcggagctttccgagaaactggaacgtcttgcagaacttaatgccttgcttaacatggatgaaaagggcgatgatgcgattggcatggatgacgaagccacggaaccggaaaaaacacatgaagatgtgaaatcggtggataaaaaagaggatgaggttgctgatatgccagcaaagcagagtaatcttggaaaaacggttacggatgataagctgtcagaccgaccagcagaacggacttcattgcaagaaaggctcgcagcaatgaaggcaagagtgtctgggacacctgcaggaagggatgcagtggataaggcaaaggggaaagatcagattttataaaaaagttttattcccaactttattcccaacctgtcagcactattcgggttgggaataaaagcaggattattaaaaatgttatagcagttgatgtaagggcagtcagtagtggctgccttttatcgtacaaaatggaggcatttatggcagaaaataatacagaaaaacaacgtgtgcaggagcttacggataaactggagcaaggattgcaggatttattcaacagtgacagttaccgcaattatcttagcacgatgtcaaaatttcataattatagttttaataacacgctattaattgcgatgcaaaagcctgacgctacgctagtggccggatacaaggcttggcagaagaattttgagcgtcatgtaaataaaggggaaaaggcaatccgtatccttgcacctacaccttataaaattaaagaggaacgggataagattgatccggttacacaagagttgttgcttgataaggacggaaatccgcagaaagaggaagtcgagataacaattccggcattccgggcagtatccgtttttgatgtgtcacagacagacggaaagccgataccggaacttgcggcaaaggagcttctttcagatgtggaagggtatcaggatatgattcgtgcagtagaagccatttcaccagtaccgattgaacttgaggagattgcaggagattccaaaggctattatgacagggaagcaaagcggattgcggtgcaggaaaacatgagcgagagccagaccttaaagaccatgatccatgaggtggctcactccaagctgcatagcaaggaagtggagcaggatgagcagatgaaaaaagaccgcaataccaaagaggtggaagcggagagtgtggcatacatcgtttgtcagcattttggtatagatacctctgattattcttttgagtatattgcaggatggagcagtggcagggataccaaggaactgagagcttccatggatacgatacggaggacagtttcggagttgattaccgggatagaggaacaattacaggaattacaaaggaacagggaagtatcacaggaacagacaaaggaaagtattctcctcatacagaatactgacctttcagaattcagtctgcttgatgtatatgacatggacagaccggaactgatacaggcattgtcagaaatgacagacgatgacaagttgagcatacaggcatatttggaaagcaggggtgcatggacaacggaaatcggcaatcaggattccagagagtacggagagtatcatctggatgtgcgttataacacagatacagatgagctgattgatatgaaggagagaaaggcggtctatgataaggcaatggagccaatcaatgccgatgatgtggttgttaagttcgcttccatttttgaaagcgaatgggaggttttgaaaatcacaaatatgttgagggatgatgtcggaaaaatgctcaaagatatggcttctcttgatgaaaaagaatgggatggcaattacctttcatatatggaaaaacagggagcggaaatcacgttacttgcgtccagcgctaaggaattaaatggaaatatgacggacttttgggattataaatacgattttgatgcaggtctgacggatgcggaggaattgtctgtcatgcaacaggcagagcatatcattaaccggttggagcatggacagcctgccttttccgatgatgaaagaaacctgattgtaaattatgcttataagctgagtaatgtggagaaaacaagggagcttgcagaacatatctatgcacaggaagtggatggaaatcaggatgttgcattagcaatggttgatgcacaggcagaaatcgacgcacttccggatagcatggtcggaatatctgaaatgcaggactatggctatacatggaatgaaatgcttccgctgacgcaggagagagcattggaactttttgaccatgacttgcctgtgtatcttttgcatacggatggttccgagagtactgtagctgatagaaaacagattttagagcatgatggaatgtgcggaatagaaaaaggagactggcagaatgaacggaaacttctcatgatgcaggaagaacttacagagagtgattccaacagggaagcacagcttttatatggaaataccgataaatacggtatttaccagttaaaggataatccggaactggataagtttcgctttgagggaacggaaagcctgaagcgtatgggaataaccaaagacaattttgatgcggtattgccggaaaattataaactggtgtatttgggcgaattgtcagaattgcagggacagacgcaatcggaaacactggaagcaatctatacaaagttcaatattgaccatccggcagattacaaggcacattccctgtcggtcagtgatattgtggtattacatgagaacggggaaaacaccgcacactttgtagattcgtttggatttacagaactgccgaagttcatgctgacactggagggcaaggaaaatgagatagagacggagcttgcggttcatatcgcagaccgttatattctcatgcatgaatgtgatgagggatacgattactccattctgaatgagcagtatcatttactggatggcggcgtttatgacaatccggatattacgattcagcgtgcaatggatatggtgatcgcagatttgaaagaaccgagattttcagctgtgaccgagcagtattaccgggatgagtatttacagggagaagtgtatgcaggttcggaggcagagatcgtcaattttgagaaactttccgaaaaagcagaggaagtggaacaggcagatttggcagcacggcaggcacaaattatcgaaaataattcggatgtggttgcagatttccgggcaaggacagaagaactgttttacagtctggacggacagagtgcggaagatattgaaaaaacagtgtatgcttatgtgcagtcgcagattgatgaatacggtctggatgcgaaaatcgtggatgtagtggtagccggaagccgttgcaggggcatggaacaggagaattcggacttggatgtggtggtggaatacaccggctcgaccagggaggatgatttgttcaatatgctccatgaggacagcatttacattgcgggaatcaaggtggatattaacccaatcacagaggggcggactggaacactggagacttatctgccagaggtggaaacttatcttgcagagaaacaggcaatgcagaaagcgtctgtggtgaaagccataccggagaaaaccgttaccttaacggttgcagagtgcggcgaatttcacagtctaggagagttacatgagaatatcgcaagcgtggaggaagcaatcgctgtgtggaaaagcataccgccggagcgcatgaacgggattccgagcatcggcattaacatacataccgagggaaccgagcgttatgaggatgtggaaatggatattctctccggcaaggtcattgacttagaggtcttggattatgtaccggatataacagatgatccgaaagcaatcgaggtcatagcggagctgattgacaagttaccggacattgaggtgcgtggttcactggaaaagtggcaggcggctatccttgcttctcagatagaccagctttcctatgattatgacacctatcagtatcaggatacggttgaggacagggaagcacaggttgccaacatcactgaggacatcagaaatggaaataccgggtatctgaatgactttctcaatgcggtcatttcagaaggcatcagagagggcgttacggacatttgcggagagggtgtggaaaattgatgacagcgaagcggttcagacagcgagaagggcaaagaagctgcttgacaagctggcagaatacaagccgcttgcaaagattgaggagcttgaagaacagaattacaacatgattgataatgtcttaaacaacggagccgagaaaaaggaaaaggagcagacaaaaggtagaatttccattaaggagaagctggcggagaaaaaggcagtcatagagcagagggataaggcggaacgtacttcaccggaaaaggaaaccgagaaaaagtcacagagggagatgtaagaagatgagtaaattcacagtagaagaaatcaatttcatgtgcgtgtttgagacacatgataggacggatatgattgggcaaatcagacaggtaatgccgcacataaaggacagcgacatggaggagcttggagagcaggtgttaggtaagctccaaaacatgactgatgaggaatttgaagatgtttcgttgaaagtgattgagtaaagaaaaattaaaaatggaagtattgcttgaaggtgaagactctatagtaatgcttcctattttagtgatattgtggtatatttaatgtgtatttttgtgtttacaaattatgcgtgcatacaggtggtaaaaatgattagcgaggtacttcaatcgaatcaaataaatacaaatgcagatgcgagtattaaaggaataggacttcaaaaagttcgtgcggcagaacggctattaaaagctgtcttacaagaaaagaaagcgctttattgcatgatagaacatgttgacgatgttttagaaggaaattggcaaggagaagttgtaaagtatacagcagaacagaataagtcatattcagtagatttttcaatgaatagtcatgagataaaaaattcgttgaggattttttttgatacttggcttggaactgttgaaatgtctgaaagtattcagtttgttttttacacaaatgttaaatttaaaaaagaaaataaagcaggtgtttttaaagataaagaagtgacttttccagatgaaccattgcttcagttattaagtgaaaaaagatatgatgaagcgtttccatttgtattacctatttttaaggcgtattatatagaacaacatagtaagcatgtaaagactccagaagatatggaaaaaattcaaaaaatattagacactatgactgttgaaaagtggaagaaattttttggattgattgaatggaattttggtgaagcagatgaaatagcggtaagaaaaagtattgataatttagttgaacaattatgtgtgcattttgatgtgaataaaaagtatgcagaggtaattacagctaaaattttggatatgatagagtctcggaaatttgaaaaagatttcttgcatagtatcgtgcatgtatcagaggttaaaattttatttttagaatttgcacaagaagcaagggtggaagaaaagctagatccaatgcatgaaaaatgggatgaaattgaatgtagtgatgtgagaaatataggtgaaaagtttttgagtgtatgcgctgaatatgaaaaagattcattagaggaattagtagatgaatatattgatggagcttatgaacaaagccatcatcagaatcacagacaggtaaaagcttataattacagagtgtataaaacttgtagaaaacttataagtagatttttaaaggagcataatggtactttaacacaatttgaaatagaacaatttcttgaaaatcttacgctcgaagcggaaaaagttattcaagataaggcaaaaacatatagtatgccttttgaagatcaagatatggttagaaaaacgattattttgttgtttcaagaatgttatttggcttttgatgaagggaggaaagtagatgaatagtaaaaagagaatgatgtttattcttgaagaggattactattttatcactattaaacttctttctattttaaaggcattagattgtgatataaagccatttgaagattatagaaaattaggaataatatttgagtttgtgaaaagtcaagaaaatacagagtttttagaaaaattaataaatcaaaaagaggataatatctttgataatgagaaatcaattaaaattttttgtgattccaagctaaatgtatccgtaataaagagagttttatttttcttggaaaagcaagatatgatagaaatgaggaaaaacccaaagaatagtaatattgatattcttttaaaaataaatgataaacttagaagtttaatagaaacgggtctattagaagaagatattagtcgatgcttgactataaaaaaattattgccaagaattagaagtttaaaactaagtacgttgcaagaaaaagtattcggatataatgaggtgacaaaatgggaagattagctgttagaagagttgtctatagtggagaaaaatatagttttgagtcaccctatctgaatgatggattagtgataatggagggagtaaatgggcatggtaaaagcacatttatgaatttaatttattatggttttggaggaagggtacaatcttttaataaacatgatgataacgtaagtaacaagcataatgaaatatgcaatgataaaaataattacgtagaactgttaattgaaattaatggtaaagaatatgaattgactagatatataggtgataacttaatatttattgtaggggaagatgaagaagtgattcaaacatgtgtgtatagaaaacaaagtgatgagtctacaattgttttttctgactggatattaagtaaattagatattgatgtttttgacattgtccaaggaacaaaaaatttcaaattaaattttaccgatttattacgattaatttatcatgatcaagcaacagaggtagataaaatatataaagaagcggataattccaattttttatctgattctttagagattagaaaagcaatttttgaagtattgcttggaaagacctataatgattactattatacattaggacaatataagttaaagttaaaagaatttgaaaaagctcaggctgttatgaatagttatgatgattttttaggagaaattttagattatgatttggaaaatgttgtacatattaaaaaaatgatagcagaaaatcatgaaatggttgaaaaagtgcaacttgagcgcaatctcgttatgaatgaagaaagtaatgctgatgaggtttggcaattaatcaatcaacagaaagcattacttatttctatacaaagagatcaagattattgggaaaaagcaaaagtattgacaaatcaatctattgataaaatagtatatttaattgatgaagcagaaaaagaattggcagaaatagaaaagatacggttggtcaataagaagttaaagttatttactccaaatacgtgtccttactgtttgagagaagtagagagaaaaaaaggaaagtgtatctgtggaagtgatattttagaagaacagtatgaaaaatttttctatacagatgaggagtatttagatatattgaaagttagaaaaaaatctattcaatctatgaatgatttattagagcgaaagaatggaagaatgaaaaatattcattctaatattgaaaaggatgaaaaagaaattgaaagaataaaaaaatatattgctgatttatcaaaggatgttacttcaaattacaattcagcatatgtaaggcaattagacgaacgcgagcgagaactaaatgcaagaatctcagaattacaacaagcagaagaattagcaaagaaacgtgacacactcgtttcagaggtgacaagtttaagaaatcaggttgaatcattgaagataaaagtagatgtgtttcttaatagtgctaaggaagatatgctgaataagaaaaaagattttgatgaaatatattcagatttaatgcaacgtgctgacggacagtgttattctgcgtatataggagaagactatttgccacatattaatatggggcaatatcgtgaacgtagtgcgtcagttcccaaacgattaatgtatttcttaacactattaattgagagtttgaagaatgacataaattttcctcgctttctgatgattgatacacctaacaaggagggaatagacaaagataatttaataaagaatattgcattactgacagaggcagataaatataattatgaaaacaaatgtccgtttcaaatcattttaacaactggcattgatacttatccagaagattataagaaatttgtattttttaaattggaaggagaaaagtatttattacaagagaatattctcgaagagaaatgttagtgtatatagaactctcgaggctaaaagacagtaggctctcctactgtcttttctttgtgtaaaaaatcgcacctgctaaactgcaagtgcgacacttttgttaatattacgagtcctacgcagctccaggacggaacaacatatgactctagtaatattatacaccatatttgtatgaagtcaaacaaaaaattattcagataaatcattagaaaattcttcacttagaaggctttcatcattatcagaagtagtaaatttctcgcctacaggataggagaagtttttgcccattttctgaaagccatattctagataatgtgatttggggatgaagttattttccgtaagataatgtagtttggtgaaaagctctacaagccattcctgaaattctgttcctggttctttttggtcaagctcattttcgtaataatgtctcacgataccagcaaatatatcggcgaactgtactgcaggagttacagcagagctgacaaacaaaggcatttctaatatgtgatggaaagaacgcccaaacttcgttttgaaaagaaaacctgtaattgcctcagcaatttttcggtcagcatcctcatgcacctcatcaaatatcatcatagctttgccatagtgatgatgattacagtaaaactcaaccttttttaaaagaaggtaatactgctttggaagatgatgctccggaacaataattggttcatctggcttgtccataattatggcaaaaatagcagcgtcataagaggtaatgatgtccaccatgccttcaacatacgctttattatttgtacggttcttagtaatagttgcttcacgaattagttttgtagactttatttcgtcctgttttccgtaaatggaatcttttaatttgtatatctgatttgtgatcggtttaatatcattttcatggatacagacaccaagcaggataggattcttggttgaatctgtagggcgagggtatccactttcgtctatgaatgtaagcatatgaatagattgctcctttgttaagtagtgaattgattatactataaaatgggttaacatactaccaaatttatagagattgttgcctgttctttatgtcttgagtagtaggcatatttttcctaagatactgattgagattttcctgtttccgtttcagctcacgcacttccttttcgcaatccttataggtggaagtcagctcacttttctgcttcatcagttcctgatactctgctttcagtttatcgacattcaagccctttaagtttatgcctgcctgctccagcatacgccttgcgccaccatagaggatgatctggctctcatatctgcggaaatatgcgtcaggattttttgactttttgtaggcgatatggtaggagcggttttctttatactgctcggcatatttgatgatttcagcaaggtctttcatgcgatgttccagttccacaacgctctgtttggcggacttgcccgcttcggtttttacagtaatcttatgctccaaatcggagagagaaccagcttcattatagctttgtgcggcgattttcagattctcgattgccgcccactgttgcagtccgggactgttctggaatttctcgtccgaggtgtcaatgagcctgcgggtggagtaatcctttttcgggataactgcctttcgttcccgctttttttcaatgcgttcccggatacgttcctttgtgtattctttccctaaagacctagcactgccacgcacaaaacgctccttgtccagaggtcggaaagagatatatttcgcagcatcttctccaaaagtttcccctttgatttcgtaaccttttgcccgcatcagaagcagaaattcttcgtaagtggaagccgacttgatgcaaaaattgatgtcccgccgaagctgtgttttccaggttgaaccattctgctcagactgccattccttgtatttttttccacgttcaccgccgggaatgatgacggaaagattgtgttctttgcacagatcatcactcaagtggcggatgcggtggtaggtctgtgtgcagtcatggtatttgttatattcaatgttgtcagccgcacaaaagatgatatgattgtgtatatgccccttatcaatatgtgtggtgacaacatacgaatattttccttctaaaaccttgtctgcaagctcctttccgatgcggtgcgcttcctcataaccgacctcgcccggagcaaaagcctgtatcagatgataggctttgttgggactgttttccctgcaatggtcaagcgtatatttaaagtcaattgctgcagtttcgggcgcacacgcataagacgaaacatagatttgttcatcggttttgtccgggttgcagatatactctatggctttatcaacggttgctttgatagcatggatttttgtgtatgccatacctcattcatcaactcctttacttcgtctatgtcctcctgataaatgtttccggtgctgtttaccctctttgcgatctggtttaaactggagctgatacgtcccagttctgtattgtaatttcgcagataactgtaatcgacatcatacacatatccatataagatcagcttgcgcaggaaagcagacatactcttcatgccggatgctttgaacttggtgttgaggatgtactgctcatcatcgctgagataaaattgcaccgaattggtgcggtttcgctttgccatttctgccacttcctttctcatttttgggtacaaaaaaactgctgtaaaatgttcgatttttacaacagttcgtttcaggttttattcagttttgggcgcaatcacccacagcagattgtagcaaaagcggcaggaaaggtcaaggtattccacaagaaaaccgaagaaaaaataaaagagggttagggacacttccctatggaaattcacacgcacagacgataggaaagtgtgggaaatttcgcctgtgtcatgacacaggcagtgcttgctaaggttgtttttggtactcctggagggggtgccggatgttttattagtttagaaaaagtaaataaagacttgacgtttaaatcttacacgcgtaagatatgagatgatatcaatttcaaattttaaaatggaatggaggaaggcacatgaagatacagagaaaaatatggaactatatattgatacttgtacttggtatgatgggcatgattacaattatcttctttttagttgagaaattgctgggggacgggagatgttatataccgcagagagcaattatgattgctttgatgttatgcgtgttttggcaggtagcattgataacagtggcatgtctgttaggaaggcggattaaaaagatttttcatggtgtagtcaaaatgatgatgacgatagtaaccgtttccggtactctttgtcttgttttgtttctcgcatggaattggttgatatatagttttaagtttgatgaaaaagtagagcaatatgatgaacatatcgctttatatgtgaataatacatttgtaagaaccagatttagatatccgcattatatgtatgaagaaaactggttaatcatgagaacgttaagtgatgatgaattgcaggaggcagttttgaaatatggtgatccagatgattattataattagcataggaaatttgatggaatttatagattcaaatttttgaaatacaattggaaaaatttttaaattgaaatcttacaactgtaagaaaaggagaggctatgacgaaaaaaaagaaaaagaaaaaaagcaggatatacattatatggctcatgaatttatgtttgattatagctgtgattgcattttttgtatggcataaaagtgtacctgatgtatcaccggagaatgctttaaaaacatacatggcgcatattttaaatcgggagtatgaacaaatgtatgaaatgattgatgcaggaacatccgggaatatcagcaaggaagattttgtaaaacgtaattctgctatttatgagggaattggtgtagataatatgaaagttcatatcacatcttatgataaagaacaaaaagagatctgttatgaaacatctatggatactgttgcaggaaacgtaacttttgaaaataaggcatcatttatactggaaaaaggcaaatataagctgatatggaatgattctttgatatttccagaactggattccacagataaagtaaaagtgtctacaacaagtgctaagagagggcagattatagaccgaaatggtcacttgcttgcaggcgagggagtggcttcttctataggcgtagttcccggaaaattagagaataagaatgatgctatcagccagttggcagaattattggaaatgaaaacagaagatatagaaaaaaaattagcggcaaaatgggtaaaagatgattcatttgtaccattaaaaacagttccaaaggtgaatgaattaaaactgatgtcgattgagccagatcaggaaacattggcagagaaagaccgacaggagaaattattagagattccaggtgtgaaaatttcagatatcactgtaagggaatacccacttggggaggctgctgcacatttagtgggatatgttcaaaacgttacggcagaagatttagaagaacacgcaggggagggatatacatcgaacagtgtgattggaaaaagtggaatggaaggattatttgaaaaagaattaaagggacagaatgggtgtgctatttctattgttgattcaaacggcaataagaaaaaaatcgtagtaagcacgattgtagaaaatggaaaagatataaaactaacgatagattcgaatttgcaaaaagaattatatgaacaatttaaagatgataagagctgttcagttgctatgaatcagtatacgggagaagtattggctttagtcagtacaccttcatatgataacaacgattttattaggggcatgtcaagtgaaaagtggaatgcgctgaatgaagatgagaacaaacctatgtataatcgttttcgacaggtctggtgtccaggctctacgtttaagccaatcatagctgctattggattaacaacgggtgcgattgatcctaacgaggattatggaaatgaaggtttgagctggcagaaagattcatcatgggggtcttatcatgtaacgacgcttcatgcttatgagccggttattctaaaaaatgctttaatttattcggataatatttattttgcaaaggcggcattaaaaattggggaaaacgatatggaaagttcattaacaaaactgggattcaatgatgtacttccatttgatattaagatggcaaaatcgcagttttccaatacagaaaaaattgaaaaagagatacagttggctgatagtgggtatggacaaggtcagattcttgtaaatcctttgcatatggcttgtatatattctgcattttgcaatgaaggaaatatgataaaaccatatcttacatataaggaagatgcaatgcctgatgtctggatcaaagaagcatttacaaaggatgcggcgcaaactgttttggaggatacgaaagaagtcataaacaatcctcatggtactggctatgcagcatgcagaacggatattacattggctggaaaaacaggaactgcagaaatcaaagcgtcaaaagaagatacaacaggaacggaattgggatggttttctgtttttacaacggatgaaaatatggatcgtcctattatgattattagtatggtagaagatgtaaagggaagaggtggaagtggttatgttgtcaaaaaagatagtcaggttcttgaaaagtggttgtctgataattagtataggatttttgatggaaatttcgggatgtaaagggaatacagaagaaccagtagcttctgaatctgttgaaattgtcgatgagagaaaaatagatgacaattttataaacattccgatagatatctatgtggaagctgcaaaaaacaatgaactaacggatatggaaaccgtatgtaaagtcataaaaagattcggggaatgtggatatgcagcggttgattgtgaaaatcgagttgatatgacacaaatgcaaagtgtgatggatttttgtgattcggtagagaaccagaaagaagcagaagtgacaattatccaagtgagtagtttgggaggattttcagtctatcatttacagacagaaaatggagtggttcatgtgaaaagatgttactacggatataaagatggaattatgaaaagtgaagatgagggtgaatatcaaaccgattattggagatatacagatgatggatatctgatgttttctggaacttatttttcagaagaattgtatgtattaacattaagttctgcagaagagcatgtagcatttcgtatactgccattggatgcaaagtgtcgggaattaaatgaaaaatatcttttgccaataggatatgagttaaataatatgtttttagtggattggaatgaggatgattttggagaactgaatttctatgacatgtttgatttgttgtatccaaagttgcataatgaaaaatttccatatgtagcagatgataacttaggcataggtgcagtttatcatattcctaaaacagagtttgaaaatgtaattatggaatattttaatatcgacagtgataaattgcagaaaaaaactatttacgattatcaaactcaaacatacgaatataaaccaagaggattttatgagatagagtatccagaatatccatattccgaggtggttgggtatacggaacattcggatggaacgattacgctcaatgttcatgtagtatatccgtatgcaggagattctgatgtatatatgcatgatgttacggtcagaccgttatctgatggtagagtacagtatgtatcaaattacattgtttcagaggaagaaaataacaacattacatggcatacgccacgcttaaccgaagatgaatggaatgatatatatggaggacagtaatggaagatataaaatggtttataaaaaagtttggaatcatttttgttatcctcttggtgatgattgtaagtgtaggaatcttttttgagaagaacgtgagaaaatcatcagcagaggaaacatgggaaaagccagtacagatatcagatatagagttttggcaggaggagtctgattacgagagggaaaatgaagataattcgccgtattggattattcctcagtcaaaaagtttactgtctgaagaagagagcaaaaatatccaaaatgaagcactaactgcggcagaactggtgaaggtggtatataaggatattgtaattatagatgatgtacctgcctatgcttctggaattgatggttttacaaatgaacagggagaacaggttataaaaatacttggaaaaagtggatatgtatgcgttaaagaaaatgtagagatgcaaaattatgataaattgcaaaatttctataaaagttatcttattggtcaggatacattgataacagtatttgtggttcaagctgatggattgcttggcgcacagacatttgtctatcgaaatgaaaagttgcaaagttactatgtaggtattcgatggagagagggcggagaaccagagatacttggaacttcggtaagtgatttgtcagaaattaaatttactgaaaaaggatattttatttatacgtttgaaaatccagttgcgcatgcaggattgagagaatattggagagtaaagttacttccagaaaaatgcagagaacttacagaaaaatatatagctggtcttagttatgtaaattataatatgctggttgtaaactgggatagcagcaatgtggaagatatattgatgccttgcatgtttgaggatatttatcgaatttatacagggaaaaatttaaaaacggacaatggggagattccagcagaagaatacgagaaaataatgactacatatttcccggtatccacggaacaactaagaaaatattgtaaatataacgaaaaaagtaatagctatgaatatgacatgatttctgccagcccatatccaccgtttggagaagtggttgattatacggaaaactctgatggaacgattactctgattgtagatggagtatgggcagattataattccgactgcgcatttacaaatcgaattgtggttcagccatttgaagatggaacttttagatatttagccaattctattgaacaaaaagaattggaattgccagtctggataggttacaattaactggacagattttttaaggtcatataatctataataaatacacgaaggagcactctttatgaccgaacaaaaacaacgacgaaaacctcgcaaatatacagatgaatttaaacagcaactggtggaactatatcgttccggcaaacgcagatgtgatatctgccgtgaatatgacattgctacttccctgtttgacaagtgggtaaagcaggcatccaattccggttctttccatgaaaaagataaccggactccggagcaggaagaactgatccggcttcggaaagaaaaccagcagttaagaatggaaaatgatattttaaaacaagcggcgctgatcttaggacgaaagtaaatgtgattaaagcaaatgcccacaaatactctgtatcagcaatgtgtcgcgtcctacaggtaaacagaagcacctattattatgaagcagcagcaaaaaaagatgaatcagaactcactgcagacattcaggaaatttttagaaaaagccggaaccattatggtacacgaaagatcaagaaagaactggctgattgcgggaaacaggtatcaagacgcaggattggacggattatgaaacaggaaggtctggtatcaagctatactacagcacagtttaaaccgcaaaaagacagatgtaatgaatcaaaagtagagaatgtgttgaaccgacaatttcaaaaccagccataccgcaatgtagtggtaagtgatttgacctacgtaagggtaggaaaccgctggaattatatttgtgtactgattgatctttttaacagggagattattggatacagtgcaggagaacataaaacagcagaacttgtaaaacaggcatttatgaaagtagacggaaatctgtcggaaatccatattttccacacagaccgtggaaatgaatttaaaaacgagacaattgaagaactgttagaaacgttccatatggaacgctccctgagccataagggatgtccttatgacaatgcagtggcagaagctacgttcaagattataaaaacagaatttgtatggaatgaaacattccatacgcaggaagaactgaagataaaactatgggattatgtaaactggtataatcatcaccgcatacattcttccttagggtatcaaacgcctgtacaatatcggaaaaataacctaaaaaaatttgtctgaaaaagtgttgacaatccagtcatagcaagaatgaatccttaatgtgactgaatggaaaggacaatatttatgaaaaagtgcatttggttcattgtactgattagttgcctgttatgtggatgcataaggaaagataggacatcagacagtcagttgatggatagtagagatgttgattctacggaagaaaacgagaatgtaaaagaagatgttgcagaacagtgggaaaaaggttatgaccttccaatagatgagccggaaagaaaagaagcagaggatgagtgtaaaatgattctggaacttatttcagatatttatgctcaggcagataaaggagaggcagctaatacggttctggatgataagacaatttataaaatgcagaatcggataaaagaaaaagggtatccggttacaacgatgaaagcatatgcagcaatggaaaattataaaaaagtcgaagattttcttaaaaactgtcaggaagagaaagctggttcggttgtgctttacgagttgcattcagatggtggcattggcagagataaatttatttttgatggaaaggacatgtatttaataggtgcgtgtgctatatggaacaccaatgatacatatggattgtcctatatttcttatgcgaggataaaggagtggaaatatacggataaaggatggttttgttatgaattatgtgttccggaaccgccggaggttacagagattgttgacggaagctgtctggtaagaataaagccattatctaaggaacaacgggaaatgtcagaaagatgcgtacaaggtctggggtatcagggaaataatcttttatgctcgaattgggatactgaccatatggaaaaactggactataatggaatgtatgaatatttgtatgccatgaaacatcagaaagcgtttgatgccgaggattatccaaatggaataccaaaagaagaatttgagagtttgatcatggaatatcttccggtaacagcagagcaaattcaggaatatgcggtatttgatgaaaaaaatcagacttatgtatgggtacgactaggctgccttaactatgcaccaacttttttcggaacttcgttgccggaggttattgatatcaaagaaaatgaggatggaacagtgacattaacggtggatgcggtgtgtgatatggtcatttgtgatgatgcggtcataacccatgaacttacggtaaagtttgctgatgatggtagctttcaatatttggggaatgaaatcctaaatgatggaataatggacatacctgattatcagtaccgtattaggatagagtgacaacgaaataatatggcacagcgtaagaggaaggtgatttaagatgatattagaacagagatttatgaaagaagatttggaagaagtgggacaggtattttcaaaatctatggagccgaaatatccaatattgaaaagtggaagcaaattgaataaaatgtggaaaagtttgctgattaaattttctttaattttattcggatgtagtgcggtgctaactgccttaaaaggtgaattttcaacagaactaattctatatgttttgattggagtaattggatttttaacagtgataatttggaacgggctagaaaagaaaatgaagccagcagatgtggtaaaacgaaaatatggtgaaccttttgttattgcaataaaggaagacacattggtttacaaacagatggatttctcatatgtagatatcagagttgttgtagaataaaaaaattttctatttataaaagtggatgggaaatggcttataataaaagctgatgaggaagagaaagaagtaatactttcaaagatgaatgaaaaaattacaattcatttcatgcaggagaaagaaccatttgatttaagaaaacttcggtaagggggacacatgaaaaaattaaaagtagttggaatattggcagtagttgtattgatagttggaagtttgtcaattccacttataaataaccacacagcctataaggtggaaaaagcattatgtgaaattccgctaccagaggaaacagaattgatagagtcgttgtcacaggcaggaaagttgacgggaaacggaaatgggatgcaatatttcggggcaattctaatcaagagtgaattgtctttggaagaactggatgcttactattcagattacagaaggaatgaatgggaatatttggtggaaattcagaaagggcagtccattgaggtgattgatcacggaggactacaattttcggaagaaataaaggacagcggttattacattgtatattcatggggaagtggagattcattattgcaagaactggatatgcgtggacactaaaatggattggagatgatactgattatgaagaaatatttcaaagttattatttgttttataggtttagtttgtgcgatgattttaattttggggatatccttttcttatattacaaattataagaagataactattgatacctcgaattcgccggatagaaaatacgaattgacacttcaggcagtcggagaaccagactggccttttggttcagcaagtggacgattagtccttatggaaagcaaagataagatatctcaaacagattttgaattgcacaatgacggtggaagcatcaccagtagttgttggaaagttacatggtatgaggactatgtagaagtaatcctgtcaggcgaagaacaatttgatgagcagattattttgaattttgatggtacggtagatatgaaacagttgcctgatacagaagttgcagagcaagaaaatgatacatctgttgaatataccacgaagcctgatagcattgatctgggagaatcaaatcaaaaaaatattacagagcaggtagataaagcgaaaaaagccgaaagctggacaatggatgaaagtaatggaaccatgtatttctttttggatgaacagaatggatggcgtttagtggtagtagatgcggctgctggaagtagattttacgttatggaacggactgctgatggcggtgatacttgggagcgaattaacgaagatccttttgataatcaagcaggcgttgctgaaggggtgatgtttttggatgataattttggaattgcaggacttgcaggtgcatctcagtctcattctacactatatattacaaaagatggaggaagatcatttggtgagataaaattgccaatgagtacggttactgaattaccagaatctgcaaaagaatatggatttacagtagaggattatgattatttaaatatgcctcaaataggtgctacaacattgataataatggttacaacagataaaggggataacgatggaattgtatttgaatcagaagatggtggagacacatggaaatatagaggggtaactcaaaattagtagtattattataaattgggtaaaggttcagtggtattggcctttacccaattttttccatgataatagaaagttagctgtacaggagatactttattgtgtccagatattcatgtcagataatatagacatggttatttcagcagcattacttccggtagcgttgttatcggctccaatattagtagcaaaaaagtatgtattatttacgatttcgatatagccgataaaccagccattcacatcttgtccacctacacgtccggttcctgtttttccgtagaattttccagtattggaagaggaaaggcagatggagtcttttacagcattgatattttcagaagaaaaacctaagctattgttttgcagtttcatcaaaagttcaacttgctccactggggaaatctttaaggaggattccagccaataagtggagagatcgccactcacattttcatttccatatccgatttgctgaatatagttgtaaatgttagtggatgcaagttgttcgtctattgattggaaataccagttaacagaggatgtcatcgcagactgtaaggtctgatcagcgttccatgcttcaaacggatagttttctccattccatgcaataaaggaatcttctggtgtaatgacaccttcttccaatccaaataaagcatcatatatcttgtaagtggaatccggcgcaactcgaagcgtagcatgttctatatcatgtatgctccagacatcatttctaagatcgtataaaacaaagcttccttcgtattttccaaagtatttagaaaaatctacatatgaaatattttctgagtaagatttccattggtagcgactttcgtccgctgcatatgtagaaataaaaggtgtaagtcccattattagaactgtggtcagtataaaagcagtcatgccttttaacttcttgtaaaacgttggtttctcataagaagcgatgttgataatgcgacgctttatttgtttcatgtttccgctaaggctggcagcaaacggaaaaggagaaatggagaccttttctataaagttaatcagcgtatttccataattctcataatcgtcttcttccagcattttcagaacagaagtgtcacaggcaacttctctgtcattacgcatttctcttagcgcaaaccagacaaaggggttaaaccaataaagcactccggcaaagttcataagataattggcaatggcatccttatgtctgtagtgttgcagttcatgcaatagcatatatctcatatcagattcatgataatctgagattaaatgaattggcagataaatacatggcttcaaaaatcctacgataataggtgatttcaaaaaagcggtactgtacacaggaatattccttgttattttcatctcattcaagcatttgttatacagtctgcgaacctctgggttctgaagggggagcgcagatctctttattgtgcgtaaacgaagagaagatttgattaccaatatcatcatcgcaagcattcccacaatccatatacctaataaaatgtatccggtaacggatggcgtgtctttatttacagaaagggcaaagtcattcatccaatttgtagtaccagataaaccggtatccataacattatttgcaccaacatcggcatgagaagcggaagagtttcttacgctactgagccatgagaaaatttgcggaaaactaattagacggaaggggataaaaggcactgctaaaagtccgagtaacagcaaccatagattatactgcatccggctggacaagttgtttctgaatacccatttggctatcaaaagaattccaacgataccgctgataaatacattgcataataaaaagcgtatcatgaaattagccatgttaatcgcctccttttttggaactcttggaaagaagggagcgaagtgtttcaatttctgtttcagacagtttatcgttttctatgtatgcagatagcatagaggtaatgtcaccattatagtagcgattcaagaaagaattactttcttgactaatatattcacactcttttactaacggtgtgtaaacaaaaacacgactttgtttttcataagtgagaacacccttggtcacaagacgcttaatgagcgtttggatagttttgggactccagcttgttgtttgtagtaatttttctgttatttcattggtgttaatgggggcatatttccatacaattttcataacttcaaattctgcttccgaaatttgtggtaaattcttcatgtaaatcactccttaaatcttacgcctgtaataaaaatagtatattctgtatttgttgaaatgtcaattttggaaaaatagttgactgtaaatcttacttatgtaataattgaattattacataagtaagatttgaggaggtggaaagttatggggaaaatgttgctgttgtcatttgaaaatagtgaagatgatgttattagcgagatattaagcatattagaaaataagcaaatgaaaatatgtgaaaataagaacataaaaaaatgcttagaatttcagggattaacaataaatgctgaaagacggttggcggtaaaaggaaacaaagaaatagaatttacttttacggaatttgaaattctgttactgttcagaggtaaacttgtaacaaaagaaccgatggtatagactaatcgtagtcaaaaccatcggttttcttatgcaaatatttctgcaatctcgcggaacagattggtctgctcttttctgcgcatcaaaaccagcatgctcatgcatttacagagatggtcgatgcttgacggactccggaatgacacagcctgcgcctgttttcttttatattttctcagcagccgttcggcttcgttattcgtggcaggtacattcttattatggaggaaaagaagatgatctttcttatactttttcatccttttgtacaggttgtatccatcacggtagtatttcccaggcggctcatagtcgtattcatccccagctatggacaggattgttttataacgttcttcaaattcggagacggtctgcggatctggctcttctgattcagataaaccattccggtaatggatcatttcctgtatcagggaatgcatctgcctgttccaggtacggtccttttcgttgtccatgctgtctttcagataacgcagtacatgtgcaaggcattcctggtggccggttccatacttataaaaggttacatcatgatcgtggaccagtgtcccctgatagtcttcaacgaccgtgccctttattccatcgtgtccctttttgcccctggcaaaatagagcacaccgccatccggaaccgcacatacaaatacatacgaactttccccatttacacgggcattggtacagtctgtatgcatgacaggggaaagcagcatgtcgcagaaaatctctttacgctgggattctgttttttgggcaaatgaccggcagagattattgatcatgccttttgatatgtttatttttccatctgtcagatcagacaaaaacctgcggcttttatcaattgatgtacagcagtcattattcagcagaaacaggaaagcacgtaaatttcctccatagttaacgtcatcaatgactccctgtggaaatggtgcatggatccgttcacctgttttggaattatagtacacatcggcatgatactcggtcacatgcacttctacgctgatgtcgattttctgctttgtaatggttttcgatgttttcttaaagtcagggtcatggagtacttcttcgggtgccggaagatagatttcccttgtcggggtgagtttctttctgcagtgccccctgtgtcctggctgtccaccgggtttccttcctgttttttcgcggctgttggatatttttttgcgggcgatagattttgaagacgggatggatgagttttcatagttccggttaatctgtgccgtcagtttctgtactttttgtttttcatcatcaagctctgtctttactttgtaaagttcccgtctctgggaagttactttttcaagggcgatgtcgcgctgtttttctgcacggatggcccttttttccatcatatccgccttttttactgcttcggcgaccatacggtcgcattctttttgcagctgttcaaaaatctcaaaccattgattccgaatcgtaatggcatggctgtgttcttttgctacagctgcttccagttttgcaattctgcgttccagggcacgcacctgtgtaaggtgctgtttttccattcggatatatttttctcccgattgaaaggctgcaagttcttcctgtgctgctttcagcctgtattgaagtactgtaatggtttcaaaagaattccccatccccatgccgcgtcctttccttaaatgtttgtcagatcatcaatgattttttctaattctgcattatgttcctcaagggatttgatcaatgaggactgggtttcgatgaccctgtgctgtagtccgtttgtatgctcaagactgcctataagttcttcatatgctttgagtttgcttttatcatctgcgttcatttgtgcctccttaagtataggataagtatagcagaaacagggacgaatgggaaatcggacgaattacgggactggcagaatgacggtggataaccggcagaaaaatgaaagaagcaggagtggaaatccgtattccagccatgtaaaagcaggaaaacatgcaggtactgtttataatttcaaaagaaaaagcaggattcggaagtcgttaacgagacttcccatcctgcttgagtttatccacaaatatatttttttaaatttcgtcagtttttacaatggtctgaacagtaacgaaattcttttactgttagcgcaaaatgctggaatggtatttagcaaggagaaaatatataatattgtttggaaagagccatattttggtgattataatattgtcatgagccatatccgcaacctgcgtggaaaaatagaagataatccaagtaaaccgatttacatacagactgtatggggagtagggtatcgcttcaataaaaatttaagcagtggtctgtaagttatagtccagatcactgcttatttttcttttttaacacccaagagatattcacaagatacatgaaaaaattctgccagagccactacttcataatccggtacaaagcgtgtcccttgttcaatgcgtaatacagtcaaatcactaaattcatatccggcaagctggagttgttcagctaatgctttttgtgatatgtgcttttcggttcgtaattcttttacacgttgtccaataaggtttttggaatttttttctttattccagtaaatcttcattcaaataccaactttctaaagatgaagtgctacatgattgattttacggaataatgttgataatatacttctaaagatgaagtataagaaaataaatttatttgatgtaatcttgggattgataatactgactgcaaaatgcaatacttatatggaaaggtggatacaaaatgaacgaagtatttgaaacagtagcagaggtattggaggaacttagaagcgaagcagaagaacgagagtattctgttcacacaaacgaatcggaaaatgcagataaagcattgaaaaaggcgaatcgggaatatgaaacggtgttggctgagctttctgcagagcacagagaatttttcgaaaattatatggatatagtggatcacgctcattttcaagaagaacaaagagcctactatcaggggatggtagatgtaatgcagatatttgacggactggggattttaaaggaaagaaacaaagtgaaagaagtgcttatgcatatcaaagaatagttcaaacagggtggatggcttaccgggaagctgaccaccctgtttttcttcagaacaattcagaaataatccagaaaaaatcgaaatctttctgctattctgtttcatgggttttatatgtacgaagataggcttctaccagtgctagaatggtggtgatctgatcgtttgtacattctgaaagataaaccagcagtctttggtaatccagattatcagttggagctgccggataaaagaacggatcagcagagatgtgtaaagcacgaatgagctgaccaagtttttcaaggcttggaacattaccatgattttcaatctctttgatatatcttgatgaaacaccggatttttcggataattcatcataagtcagcttttggtctaatctggctttcttcaggcgaaaacccatgtctttatcaattttcttagatttagccatgtcatgcacctccgtatatagtgtatagttcaccatttaaaaagaaaatgaactaataacgcactatatcagaggaatataatgcacttaaataaaataagtaactttggatattgcatataaaaaacgcagtattcaaaggttttttctcatgtttttatcctttgaatgtgtttgggagagctatgtattctgaaccgttgaaaggatatttttgtatttggaaaatattatcctgcccattgcgtggaaggacaggtaaataggttgcattttaagtaatgcggcaaattctacaattgaaagtgcattatatacactcacaaaatgtggagaaaatttaatatcagctataaacagcgtcctgtgggtatgtgctcataagggcgttttttatatacagaaaaatttttctaaaaatttttcaatccacccgaacatctccctggtttcatttgggagatacaccggaagggaaaaaaggcaaaagccttggcattcggaacgggaggaggtgaactcgtatggggcaaccttcttctaaggatgaaatgactatccggcatcaatttgaccggttatgccagatggcattaaaaggcgaagctgtaaattattacaaacacatggactatcgcagaaaacatgaagtaacattctctgaactgtcggaaaaggagttgagcaaattatttactatggatgagtatggaacagaatatcatcattttgaagtgcatggctatgacattgaagtaaaaaataccctgattgctgaagctttgaaggaacttacagaaagaaaaaggaatgtcattttactttcgtattttatggaaatgagcgatgcggatattgcaagagaaatgaatctggttcgcagtaccattcatgaacacaggactcgctcacttgaaattttgaagaagatcatggaaggaatagcagatgaaaaagatgtataaaagcagaaatgaggaaaatttgttgcctttccatattataaaggcagcatcagagggcgatgtaagtgccatcaatgcagtgttgaaacactatgagggatacataatcaaattgtctaccagaaagttatatgacgaaagtggacaggtgcattactgcattgatgaaacgttgcgtcgcagattggaaaccaagctgattacaaaaatattggcttttgaagctgcatagcatccgatcagaaaattccctttctattcattgattggaaatgatgcagcgatgtaccttgacaactgaatattgattgcatacaggacgtgaggatatgcggagccactaggcaggttcgccaagagatacctgctctttttgagtgaacgtgagggaatgttgaaacactacattgaagcaaaggtatggagcgagaaaaatctgacaaaatgtgtggcagtaacacagggcgatgaagcatatctgtaataatgatacttccggattgtaaagaaatttgcagtccggtcaatttgaatgacggtgcaagaccgatgtgggcagagtaatgatctgccacctgtattgcttttttatctgcctatgagagcctgcaatggggtgggggttgtcattggcagataaagtgctgcctattttaaaaatttggaggtgttcataataaataatatagaagaaagagtagagggcaagatggttccaatctgggagaagtatatgctgacggttgacgaagcagttcaatattttggaattggtgaaaagaagataaggatgctgatttctgaaaatactgatactgattattgttttacggtgcaggttgggaataaatcgttgattaatcggcataaatttgaagaatttcttaatcaaaccacttccttgtagaaatgaaaaatacaaaactttatcactttaaagtggtaaatgccgccctggtatgatataatatggttgtcgtgctagggcttcttcgtagaaaggagcaaagacgtttgagtgaaagaaatcgcaatcagaaaagacgtgataaaaaaggacgtattttacgaaacggagaaagccagcgagcggatggaagatatgcatttgtttatacagactgctttggaaaacagaaatttctttacagttggaagttggaatcgacagatcctcttccggtaggaagaagaccttgtcagtcacttagagaaaaggaaaaagtcatattaagggatataaatgatggcattactccttatggtgataatttgacagttcttgagttggtaaaaaagtatattgctcagaagactggggttcgccataatacagctgcgaattataattttgttatcaacattattaagaaagaggaatttggagcattaaggattgataaggtaaaactatcagatgcaaaagcatggttgattaagcttcaggcagatggtaggggatacagcaccattcattcagttcgtggagtggtaagacctgcttttcaaatggctgtagatgatgatttgattcgtaaaaatccgttcgagtttcaactatgtacagtagttgtaaacgatagtgtaacaagagaagccataaccagaaaacaagaaagaaagttcttggaatttattaagaatgatgagcattataaacgatactatgatggtatgtttatcctctttaaaaccggacttcgtatttcagagttctgcggattgacactttccgatattgattttgaagaaaagcaaatcagtgtaaatcatcagcttcaaagaaccagagatatgaagtatgttattgaagataccaaaacgtcaagtggaactagaatcattcctatgactgaggaagtgtatgaatgttttaagcgtattgttgaaaatcgtaaaaagcccaagaaagaacctgtgattgatggatataagggatttctgtttttagataagaaggatatgccggaagttgctttacattgggaaaagcattttgagtgggcattggctaagcataatcgaatctataaagagcagttaccaaaaatcacgccgcatgtttgcaggcatacctactgcagcaatatggcaaaaagcgggatgaatcctaaaacgcttcagtatcttatgggacattcagacattggggtaacattgaatacatatacgcatctgggagcagaggatgccaaggaagaacttggcaaatatgctaagatggcttaaaagatcaagaaaattgatacaactaaaagataacctaagtggaaaaagtctttagtaaaatgagaaaattaagctgttttactaagatttttactaaatttggatgacaagatatacgaatttatgccacgatatgcgacgaaaacaaagaaaatactctatcacagcaaatcgtataaagtggcgtaaaatcaaggaaaatcagcattttcaaggagtttttaaggcatgattaaaatattatttgtgtgccacggcaacatctgccgctcccccatgtccgagtacctcctaaaggatctggtggaaaaacaaaacctcacttcccacttcgagatcgcttccgctgccaccagcagcgaagaaatctggaacggcaccggcaatccgatctacccgccggcgcaggcggagctgaggaagcatgggatcgggaaaacagcatacacgaatttttcaaaaaaacgtgcacggcaggtaacaaaagaggattacgggtattatgactatctgctctgtgcagatgcaaataacatcaaaaacaccatacgcatcacgggaccggatgtcgatggcaagataaaacttcttttggactttgctacagatcccaaaagaaaaggaaaatccatttcagatccatggtattctggcaggtttgacgagacctaccgggatgttgtttgcggttgtgagggactgctcgcatacttgaaagaaacagggcagatctgataaaaaaatattgagaaagacagtgtcgatgatatctgtccgtatctgccacgaaagtcagtcagaccaaaatctgacaatgaaagggtggaatcggtcagaacaggagacactgttttttattgcccaaaagtaacagaaaaatattttcgcatattttcgcctgaagtcaatacccgaataattaataaaaatcaatttgtaaaattggtcaaacagacgaaaatagaattaaaatacgaaaacaacttgtataaatcaacgaataaatataagatatagaagtacgaaaaaatacgaaaatttgaaagaggggggagagggacatgtataagaccggttaatgatcttatccggcaaactggggtatgatcgaaaatcgaaaatgggggactttgaaaaatgagaaacaaaaagattttacagaaggccgctaagaaatcacttagctggcttttaattttaggtatgctggtaacgttaccagagacgccgggagccatatctgcagcggcggcggagcttgaaacggggacagaagaaacggtacatgaagaatccggcgatgcagatcgtgtggatgaaacaaaaaatgctgtgacagaaaaaaccggggaaacagagacgaaagcagataccgcggtacaagaagaaactggtacaagtcagagtcaggaaacgaaagagccggaaacagagacccaagatgcagaagcagagaacgaagatgcagaaacagaggatgcggaagcagcagtaacagaagcagagacccaagatgcagaaacagaggcacctgtaacagaaacaacggaagatgagactgaattatccgaggaaacagaagaaacggaaacagagcaggaagtgaaagctgtggaaggagcaatgaacctgacactgcacatggataacagttctgcaaagtacaaaacgcctgcacttcagttctggggagatgataacacaatcgtatctggtgcaacggaaaaaaaccaggagattacaggttgggaagacgcagtaggacagcttctgacagcggataaagacggaaaattttacagtgtaacattaaacggtaattttacgggattccagtttttagattatgcagatccgtcaaagaacacagcaggacagggatttgtcagcactatgacatcatatactggtgacactccgacagatctctattacatctgcaaagacggtaactggggctggtatttagatgcagcaggcacagaagccttaaaagagccggaacttgtttaccttaccatgcatatcaaaccggaaacgaaatggtcaaagccggcaatgcagcactggaatgacaaattgactatcactgatacaaaaggtcagaaaacgatcatcggctgggacgtaaaaggagatcttttcacagcagaagagaatggattttacaaactcactgtcaaaggaacattcggaggctttcagtttgtagatgcagataatgcggatgatacaaaaacaggtgacaatacttacgacaaactgttggataaatttgtagcagaaacgccaaccgatgtatattatatccagaaagacggcacctggaactggtacatggataaagatggaacaattacacttgcttccacaaaagaggtatcggaccaggcagtcgacaatgcagatggaactaccacattcacggctgttgcagaaaacgtaaaagataaagtaaaggttgtttatggtaaaaaatcagaggtggaggaaaaaggaacttctgcattaaagacggttaccatgacagcagataaaagtgttgcaaatgcatataccacggatgcgattttccttggagatgatgcattggacatcgtatattacatcgaagtagatggtgtaaaaaaagacattgaaacatccgctggtgttacagttggaaaagatacttatctttcttattccagagataaatttaccggcagaatggtctgtgtaccgggtacatttcctggaaaaagctgggatgcagcatcaaatataatgacatacatgggagaggggttatattcctatacatttaaaaatgttccggcggcaaattacgagtacaagattgcgatgggtaactggagagaaagctatggtgcaggcggtgctgcaagtggatcgaatattgcagttaccgtgacagaacctcaggatgttacgatttattattcggacttcagccattattcaaaatgcagtattgattataaatttggggcaagcctgttattgcagggaacaggaattctggcagatacaagattttctgacagcagattgaccggaatttacagcgcaactgtggcaaacatggaagctggtacttattccgatacgaagatcgtatcagaggatgagactgttgaaatggatccatatacggtagataccacaaaggatgttacattctattatgatccggaatcaggcatttattattcgaatgcttctgacaaagaagttgcaacaaacaaacttgtatttgattctaaggatacagcttacaaatcagtatacggtgcggtggcaaccggagaggaagttacctactccatcgataccggagatgaagttactgcagtcaaactggtcgtaaaaggcgtggcaaagaaaacactttccatgaaaaaagcagagggtgcggaagatggaaaacagagatggtctgttactacaagctatgacagacttggagaatatcagtatttctttgcagtatacaatgaaactgcagtggtaatgtatggcgatgatgacggattttatggggccggtgtggcagccaatctgttaaatcttttaccatatgatcagatcgtatatcagtcaggttataagacacccgactggatgaaaaatgcagtgatctaccagatcttcccggatcgtttctataatggcgatgtgacaaacgataccatcacttcggatgcaagaggtacggtacagtatgagtatatgaatgactggtatattttaccggagaacccggagcagatcacattacatccggatacctatccgacttacgcatataagggcgatggaaactggagcaatgagatctatggtggagatttaaagggtattacaaaacggatcgattacttaaaagcacttggtgttaccgtgatctacttaaatccggtatttgaatctatttccagccacagatatgatacaagcgactataaaaatattgatccgatccttggaacacttggagattttgaggaactggtcagcgtagcagaagcgaataatatgcatgttgtattggatggtgtattcaatcatgtatcggatgattctgtttattttgaccgttactatgagtatctggaagatggaaccgatacgatcggagcttatccttactgggcatatgtatacgatgccatgagcgagaaaaagatttccaaagaggaagcagaaaaacaggcaaaagaatattttacggcagagtatggaattacaaactatgactatacagaatggtttgatgtattttccgatacaactttaaaagatgacaatgacgatgaagtatgtgattccgtaggacttcgtgccggaaaaccagtatatggttatgatggatggtggggttatgactccatgccgatcatcaaggcaacgaacggttccgaatatcagaccggtacctgggcagaagaagtaatcggaaaaaatgagacaagtaagaccgcagataacagtgtaacacagtactggctgtcaaaaggaatggacggatggagactcgatgttgccaatgaagtatcggatgagacctggcagcatttccgtaaatccgtaaaggcacttgacagtgataacgtgatcatcggagagatctggacggatgcagtcaaatatctgatgggtgacatgtatgactctgttatgaactatatgttccgtggagcagcaatcgcctatgcaaaaggcggagattcaaaaaatgcgttaaatacgctggagcgtttgagagagcgttatccgaaagaagcattttatgcgatgatgaaccttgttgactctcatgatacaacacgtttgttatcttacttagatggtattgatgacgatagaaaccagaaagaaattgcagaggcattcccgacttacgagaatacttcagatgcagcaaaacagaaacagtatttagttgcgttaatgcagtttacctatgcaggtgcaccgacgatctactatggtgatgagcttggtatggtaggtgcagatgatccagatgaccgccgtgcgatgatctggggcgaaggaaatgagaatctggtaaaatggtatgcaaaacttgctgcaataagaagcagttacagtgcattgagaacaggctccgtagagccggtatatggcacagataaagaaattttaggctatgtcagaagtgatgattcggatatcatgcttgttttgatgaacaacagtgcagcagacaagtctgtgacagtaaatgttgcagaacttggaattaatgcagcagaacttgcagatgtgatcgcaggtaatagttacagtgctgcaggaggcagcgtgacggtaactgttccggcatacaatggtgtgatcttaacagacaagggtcatgtaaaacaggtttctgtggatgaagaaaacttaaaacctggttttgatcctgcatataagattaaggcagaagaacgtgcagtcaaagtaacaggagtttcactgaaaaagacagagatcaccttacagaaaggtaaaacagcaaacatttctaaaaatgtagtagtagcaccgcagaatgcaacaaacacagcagtaaaatacaagacttctgacaaaacagttgcttcagttgacaaagatggtaatgtaactgcaaatgccaaaggaactgcaacaattaccgtgacaacaaaagacggactgtttacatcagaatgtaaagtaactgtaggagatcaggtacaggcagcgaagatcaaattaaacaagacaaaactcagcctgaaaaaaggaaaaacatataccttaaaggcaacagtcactccgaaggattgtacggataaagccgtgaaatggaaatcttccaaatcctctgttgtaaaagtagatgcaaacggaaaagtaactgcaaagaaagcaggaaccgctacaattacagctgccacaaagaatggtttaaaggcaacctgtaagatcacggttacagatccggcaaccaaagtatatctgacaccggcgatgagtatcaaaaagggaagttccgtaaaactgacagcatctgtatttccgaagacagcgacagataaacttacatggtctacatcaaacaaaaaggtagtgacagtaacaaagagcggtaagatcaaaggagtcaaaacaggaacagctacgattacagttaaaacaacaagtggaaagaaagcaacctgtaaagtgaccgttgtaaagagtaataagaagtcagcaggtattaaactgagtgcaaagaaactgacattaaagcaaaatgcaacaaaacagctgaaagctactcttgataagaatgcaacggacaaagtgacatggagcagttctaacaagaaagtagctacagtcgataaaaatggtgttgtaacggctgtaaagaaaggtactgtaacgattaccgcaaagacatcaggtggaaagaaagcaacctgtaaagtgacggtaaaagtaccggcaaccaaggtaaaattaaacaaaaccaaggcgactgttgcaaagggcaggactctgaccttaaaagcgactatgacaccttcttcctcaacagataaacttacctggacgagttccaacaaaaaagtggcaacagttgataagaatggtaaagtcaaggcactgaaaaaaggaacagccacgattactgtaaaaactgcaagtggaaagaaagcagcctgcaaaattactgtaaaataaaaaaagttgtaaaaaaaatattgcaaacaggaaatcaatgtggtataaatgttacaacgttaaaacagtaaagcgatgaaagagactctgatctttgggcgtcgacaggaatacagcgtcaccgactgagagcgctgtttgaaagagaaggtcaagggaacactctggagcagactgattgaacaggaatttgcacgagcggttgatcttaaaaacagcggcagtggatcgaaagtaggtcagtacgtgggtgcgcgttaagcacagagagcggaaagatgatgagaacgacatcatttttcaatgcgggtggtaccgcgggatactaagagatttcgccccggaaaagcatatgcttttccggggttttttgtattcatgataatagaatgttcgcggagcgtgcattctattatttgttgaaaatctgaaagacagagttttgtttttcaaaaaggttcccgtcccgcaccttatcatatctaaaggagtgtacagaatatggaattcatgacaggtgtaaacaaaaaggaaaccttagagatcggtgatttactgaccggcagctatgagggaaaaagtgtaaaagtaaacggagcagtgcataccatccgtgatatgggtgaagttgcatttatcgtcttaagaaagagagaaggactgctccagtgtgtttacgaagaaggaaaaacacagtttgacttaaaagatttaaaagaggcagcaacgattgaggtggagggaaccgtaaaaccggaggaacgtgcaccacacggatttgagatccgtctggataaaatcaaggtattgtccgaaccggctgcaccgatgccgcttgcaatctcaaaatggaaattaaatacctccttggaggcgaatttaaacaaccgtgcgatcgcccttcgaaatatcagggagcgtgcaaaattccgtattcaggaaggtgtggtacggggatttcgtgatttcttatacagtcaggggtttacagagatccatacaccaaagatcggtgcaaaaagtgcagagggcggggcaaacctgttccggttggaatattttcacagaccggcagttttacagcagagtcctcagttttacaaacagatgatggtcggcgtatttgaccgggtatttgagacggcgccggtattccgtgcagaaaaacataataccaaacgtcacttgaacgagtacaccagccttgattttgagatgggatatattgatggatttgaagatatcatggcgatggagaccggatttttgcagtatatgatcgcactgctcaaaaaagattatgcagaggaactccggttattaggcgtcacactgccgaacgtcgacaaaattccgaccgtgcgtttcgatgaagcaaaagaaaaagtggcagaaaaatatcaccgccagatcagaaatccatacgatcttgagccggaggaggaagcactcatcggacagtatttcaaagaagagtatgatgcggatttcgtatttgttacacattatccatccaagaaacgtccgttttacgcgatggacgatccggcagatccgacttataccttaagttttgacctcttatatcagggacttgagatcacgaccggtggacagcgtatccacgattacaacaaactgatggaaaaaatcgaaaagcgtggtatggagtctgagggaatggaacagtatttatccgtattcaaacatggcatgccaccacatggtggacttggaatcggtttagagcgtctgaccatgaaattagtcggtgaggacaacgtccgtgagacgacgctgttcccgcgtgatttaagcagattagagccgtaaatccaaaatattttgaatgtaaaatggagttttgcaaacagacatcatatgaatgaaaaaggagaacagccgtgaaacatttgggaacaaaaacaatcgagacaagacgtcttgttttaagaaaatttacactttccgatgcagagccgatgtaccgcaactgggcatctgacccggaagtgacaagatatctgctgtggccggcacacgagagcgaagaggagacaaaaggtattttgaaaggctggattgccgcctatgagaaaccggaaaaatatgaatggtgtatcgaattaaaagagatcggtgaggcaatcggcagcatcggtgtggtgatggtcaatgaaaaagtacagtccatggaagtcggctattgtttaagctgcgattactggcataagggaatcatgtccgaggcgctttcagccgttgtggaatacctgaccaatgaagtcggcgcacgcaggatccaggcgagatgtgataccagaaatccatactctgcgaaagtgatggaaaaatgtggattaaaatatgaaggaactgcgatccaggcagagtggaacaactccggggcaggggatgttgcctgctatggtctggttgttggaccggttgttgttgaagagccggaggaaaccctagaaccggagatcgaagaggaagaaccgaaagtcattaaaacaggacgcaaaaatgagatctcagacgagacgatcgagtatgtcggaatccttgcaaaattagagctgaatgaggaagagaaagaacatgcaaagaaagatatggaagaaatgctcaactatattgataaattaaatgaacttgacaccataggagtggagccgatgtcacatgtgttcccggtaaacaatgtattccgggaagatgtagtgacaaacggagacggcagcaaagagacgctttcgaatgcaccggcacagaaagacggtggatttaaagtgccaaagacaattggagattaatcagattgctcaaagaacattttgtgcagcaggcaaagaaaatgttcggataaaaagcaggagcaggaatggagatttatatgaatattatgagtttgactgccgtggaactcggcaaaagaataaaagcaaaagaaatctcagtagaggaagctgttacggcggcgcttgacgcgattgagaaaaaagaaaaactcgtaaacagctttgtgacagtagatagagagggagcactgaaacgcgcaaaggaagtacagaaacagattgatgacggcacactgacggggccgctcgcaggtgtaccggttgccatcaaagacaatatgtgtacgaaagatctgcttaccacctgttcttctaagattttatataactttattccgacctacacggcggaagcagttttaaatctggaaaaagcaggagcagttattttaggaaagaccaacatggatgagtttgccatgggaagcacgacagagacgtccgcttacggtgagacaaaaaatccatggaacacagagcatgtgcctggcggttcttcgggtggttcctgtgcagcggttgcggcagaggaatgtgtctttgcacttggatcagataccggcggttccatccgtcagccgagttccttctgcggcgtgaccggaatcaagccgacctacggaacggtatcacgttacggactgatcgcttacggttcatccttagaccagatcggaccggtcgcaaaagatgtgactgactgtgcaacgattttagagacgattgcttcttatgacacaaaggattccacttctgtaaaaagagaagattacgattttaccagtgcactggtggatgatgttgcaggaatgaagatcggtattccgcgtgattatttcggggagggtttagatccggaagtaaaagcagcagttttacaggcagcagaggaattaaagaaaaagggcgccatcgtggaagagtttgacttaagtctggtagaatatgcgatccctgcatattatgttatcgcctgtgcagaggcaagttccaacctggcaagatttgacggtgtcaaatatggttaccgcaccaaagaatacgagggacttcacaacatgtacaaaaaatcccgttctgaaggattcgggtcggaggtaaaacgccgtatcatgcttggctctttcgtgctgagcagcggttattatgatgcatattatctgaaagcactccgcaccaaggcgttgatcaaacaggcatttgataaggcatttgaaaaatatgatgtcattttaggaccggcggcaccgaccactgcaccaaaactgggacagtccttaagtgatccaatcaagatgtatttaggagatatttacacgatttccgtaaatcttgccggcttaccgggaatttcactgccgtgcggcaaagataaaaacggtctgccgatcgggttacagcttattggaaactgttttgaagagaagaagatcatccgcgcggcatatgcatttgaacagacaagaacctatgagcacagcccgcttgcatagtccgaaaatggaggaatagacatgagtaaaatatatgaaactgtcattggacttgaggtccatgttgagttagcaacgaaaacaaaaatcttctgcggctgttccacggcattcggcggtgcaccaaacacacatacctgtccggtctgtaccggtatgccgggttcccttccggtgttgaaccgtcaggtggtggaatatgcgatggcagtgggaattgccacaaactgcagtattacccagtactgtaaatttgaccgtaaaaactatttttacccggataacccgcagaactaccagatctcccagttatatctgcccatctgcagaaacggtggtgtcgagatcgagacagcagccggaaagaagattattggtatccatgagatccatatggaagaggatgccggaaaactggtgcatgacgagtgggaggatgtctccatcgtagattacaaccgttccggtgtaccgctgattgagatcgtatccgagcctgatatgcgttccgcggaggaggttatcgcatatcttgaaaagctgcgcatgatcatccagtatctgggagcatctgactgtaaattaaacgaaggttccatgcgtgccgatgtcaacctgtccgtccgtgaagccggcgcaaagaagtttggaacccgtaccgagatgaaaaacttaaactcctttaaagcgatcgcaagagctatcgagggagagcgtgcacgtcagatcgaactgcttgaagccggaaagaagatcgtgcaggagacacgccgctgggatgacaataaggaatcttcccatgcaatgcgttccaaagaggatgcacaggattaccgttatttcccggagccggatctcgtcccgatcgtgatcagcgatgagtggatcgcaaaagtaaaggcaaaccagccggaactgcgcacggaaaaattagagcgttaccagagagagtttgatcttccaaaatacgatgccgagatcatcacaggacacaaaaaatttgcagacctgtttgaggcggcaaccgagctttgcggcaaaccgaaaaaagtgtccaactggatcatggtcgaaactatgcgtctgttaaaggaaaacaacatggatccggaagacatccgtttttctccggtcaatcttgcaaaactgatcaatcttgccgattccggttccattacaaacacggtcgcaaaggaagtattcgaactgatctttaaagatgacattgatccggaaaaatatgttgaagagaaaggcttaaagacagtcaacgacgagggtgcactccgtgagacagtacagaaaatattagcagaaaatccacagtcggttgaggattaccataacggcaaagaaaaggcaatcggattcttagtcggacagaccatgaaagccatgaaaggaaaagcaaacccggcgcttgtgaaccagatattaaaagagttactgtaaggtattatatttgataccaacatcatgtgtataaaaatatgaggactgaaaaaagtcctcatatttttgcgatagcttgacaatcttgtttatgcgtgcatatactaagataattgcgaaactcattcatgaactggcgatgttgtggaaaattgacagatgaaaaagaaagtgctggggagccgtcggtacttagtgactgtattttggtcacttagtatccgctacgagcgacacgcagcgagagcgtgctttcgtttcagctgtcaatttcccacaacgttcacagcctaaagcagagtttcgcccaggtaactgttttattgaatagcatggaaagaaggagcaaaatgacctatcatttatccgacgagcaggaaaaatacttttatgacaccttagaggaactctgcaggcagtcccgcctgttagagtcacaccgctatatgcagcacggtgacaccagcgtgttccgccacagtgtgtcggttgcatatttcagctattatctggcactgaaaatgaatgcgccggtggatatccattcgctggttcgcggtgcgctgttacatgattattttttgtatgactggcatgagaaagatgcatcacataaatggcatggatttcatcatgcaaaaaaggcgtgtgagaatgcagcccgtgatatcccggatttgaacgagatagagaaggatatgataaaatgtcatatgtttccattaaatatcgttccgccaaaatacatggaaggctggatcttatgctgtgcagataagatctgttccggggcagaaaccgtgaaaggacgcctgccggagcatatcgttctgccgtggaggaaacagattcgttcagaattatagaatgtttgtgagtttgaccaaaaatggagactaaaacgggcatatataaagttttcgctttatatatgcccgtttttcatgcaaaatgttagccttccgcaagatttcccgtgtaaagctgatagtattttcctttttcttccatgagtttgtcatggttaccgcgctcaatgacgcgtccctgctctaatacgatgatacagtcactgtttttaacggtggagaggcggtgggcgatcacgaatgtggtgcgtcctgccatcagtttatccataccgtcctgaacaatcttttcggttctggtatcaatcgaactggtcgcctcgtcgaggatcagtaccggcggatctgcaatcgcagcacgcgcaatggcgagaagctgtctttgtccctgacttaagttggcaccgtcaccggttaaaagtgtgttgtaaccgtccggaagctgatggataaaggtgtcggcgttggcaagttttgccgctgcaatgacttcttcatcggtggcgtcaagttttccataacggatgttttccatcacggttgcggtaaacaggtgtgtatcctgcagtacgataccgagagagtggcgcaggtcatcttttttgatcttgttgatgttgatgccatcgtaacggatcttaccatcctggatatcgtagaaacggttgatcaagtttgtgatcgtggtctttccggcaccggtacttccgacaaatgcgatcttctgacccggtgttgcatagaggtctacattgtggagtacgatcttatccgggttataaccgaaattgacatcatcaaagactacgtcacctttcagctcgatataatccacactgccgtctgcctgatgggtatgtttccatgcccacataccggtgcgctctttggattcgacgatctgcccgttttcttttctggcacgaacgagagtgacatagccgtcgtcagtttccggttcctcgtcgagcagtttaaagatacgctcagaaccggcaagtgccatgacgatattgttgagctgcatactaagctggttgaccggctggctgaaactcttattataggtaaggaaacttgcaagttttccaagggtaaagccgccgacaccgtttaaggcgagcacgccgccgactaaagcgcagagcacatagctgatgttaccgatctgtgcgttgaccggcataagaatgttaccaaacttattggcattgtccgcactgtggaaaagctggtcatttaatttgttaaagttttcaatactttcttcctcatgcgtaaagacctttacaactttctgaccgttcatcatttcttcgatatagccattgacggttgcgatatctttctgctgtgcgataaagtatttggcactgagtgcgccgatctttttggtcgcaaacagtgtgacaccgatcatcaggagtgttacaatcgtcaggggaacatttaagagcagcatgctgacaaatacgctgacaatggtgatgatgctgtttaaaaactgcggcatactctggctgatcatctggcggagtgtatcgatatcgttcgtataagtggacatgatatctccgtgatagtgcgtgtcaaagtagcggatcggaagttcttccatatgggtgaacatgtcatcacgcagattctttaaggtaccctgggaaacatttaccatgatgcgtgtgtatatataggaagcaagtgctccgatcaggtagaaaatggaaacgcgcatgatagcgtgcagcagaccggaaaagtcaggatctgcctgaccgatgagcggcaggatatagccgtcgatcagagtctgcataaaccaggtaccctgtacactggcgagtacggtaatgaagatgcagatcacgacgagaatacagtgcactgcataatttttcatgatataggcgagcagacgcataaataattttcccggattttcaactttcgggcgcggaccttttggacctctgccgcccggtccctgaaccggtttggtattcttttctgccattatgcagcacctccttcatcaaaatcaccgcttccgctggtctgtgattcgtagacgtcgcggtagatatcattggacgctaacaattcttcgtgggttccaaaaccgtttacaacaccgttatctaaaacgatgatgcggtctgcattctggacggaggagattcgctgcgcaatgataaattttgtcgtatccgggatctcctcggcaaaagccttgcggatcttagcatcggttgcagtgtcgacagcactggtactgtcgtctaaaataagtattttcggtttctttaacagggctctcgcgatacataaacgctgtttctgaccgccggatacgttggttccgccctgttcaatgtaagtgttgtagccgtccgggaaacggtcgataaattcatctgcgcatgcaaggcggcatgcgtggcggcattcttcgtcggtcgcatttttatcaccccagcgcagattttcgtaaatggttcccgagaagagcacgttgttctgcagtaccacggaaacctcgtcgcgcagcgtatccaggtcgtaggagcggacgtctttgccgccgacaaggacttcgccctctgagacgtcatagagacggctgattaagttgacgagcgaggatttcgaacttcccgtgccgccgatgacaccgatcgtttccccagagcggatggaaagattgacatcatcaaggatcggtttatccgaagtcttgttgtaacggaaggtcacatggtcgaaggtaacactgccgtcggcaacctcatagactggattttccgggtttgtgatatcactcttttcatttaagacttcacagatacgctcggcacttgcgatactcatggctagcatgacgaaaaccatggagagcatcatcaggctcatcatgatattcatacaataggtaagaagactcattagttcgcctgtggtgagagaacctgcaacaatcatttttgcacccagccagcttaatgcgatgatacagctgtatacggcaatctgcatgacaggggagttgaaggcgagtacgctctcagctttgacaaacatgttgtaaatatttttgcttgcggtcgtaaattttttcttctcgtaatcctcacggacataggctttgactacgcggattgcggagacattttcctgcacggatgcgtttaagtcatcgtattttggaaatacttccataaaataatgatgtgcacgcacagtgataattgcgaggatcataccaagtacgataacggcgatcagataaaccgaagcaagtcttgcattgatgaaaaatgccatgatcattgcgcagatcaaagagatcggtgcgcggacgcacatgcgcaaaagcatctgatatgcgttctgcaggttggtcacgtcggtggtaagacgggtgacaagacctgcggtgctgaatttgtcaatgttggaaaaagaaaaagtctgtatattttcatacattgcttttcgtaagttgcgcgcaaatcctgcggaagcgcgggcaccgtattttccacccatcgttcctgcaaacagggaaatgcatgcgacaatgaccatacatccgcccatgacgtaaatatggtggatatccccggcctctacgccgttatcgatgatcgatgccatcatcagtgggatgatcgtttccatgagcacttctaagatcatgaaaacaggagtgaggaaagaatcctttttaaattctttgatctgggctcccagagtttttaacataacatcacatccttttcaaaaaataattgatttttatttgttagtgtgctaacaatatagttataaggcatagaaaaacgaatgtcaatgtaaaaataattttatttcagcaggagaaaaacgatgcatacagacacgatcggatataaaatacggctgcttcacaaccagatccacaagcggatggaggcaaaaaggcaggaaaatgaaaaagaaccgctgacgggaatgcagcgctggacgcttggctttttgagggatcatgacgggaaagatatttatcagaaggatatcgaaacagagttttccgtatcgagggcaactgcatcaaatatgcttgcagtcatggagaggaaagggcttgtgcgccgtgaggcggtggagcatgatgcgagattaaaaaagctggtgctgacagagaaagcacgcgctttagtggacagatcagagcaggatatgcgggatatggaagcacttttagcgaaaggactgagtgaaggggagatacgggatctgaagagatatttagaccagatgctttctaatttagacgtggatgtcgagtgtccgaagaattctttttgtggcggcatgaaaaatagaaacactagatgttgtggtcaataaaaaaccagatacaagtgaaaaaaatgacgaagaaatcaacttaaatttggtaatagtgaataaagaccgcatatttactggggttgaggcatttgcttttgccaaagtgcccataaaatgggacttttgaccgttggcaaaacgcattgacaaaaacacaatatattgtataataaatactcgtaggttatgcggccgtatgggtatggcaggcagccatcagtcagaacagaaagggatttgatcggaaatgaaaattattaaaagaagcggtatggaggatacctttgatattaaaaaaatcgaggcggcgatccgcagagcgaacaacagcgttattgattatgagaagctgacggacaagcagattgacgagatatcaaaaaatgtggaagttgcctgtgaaaatatgaagcgttccccaagtgtagaggaaattcaggatatggtggagaaccagatcatgaatcagcgtgcatttaatgtggcgcgcaactatattacatatcgttacaaacaggaactggtgcgcaagtccaactcaacggatgaacagatcttaagtttgttagagtgtaataatgaggaagtaaaacaggaaaattcaaataaaaacccgaccgtaaacagtgtacagagggattacatggcaggtgaggtcagcaaggatatcacaaagagatttttgctgccgccggatattgtggaggcgcatgagcagggaatcattcattttcatgatgcggattattttgcacagcatatgcacaactgctgtctggtcaacttagaggatatgctccagaacggaaccgtcatcagtgagacgatgatcgaccgtccgaagagcttttcaacagcatgtaacattgcaacacaggcaatcgcccagatcgcaagttcacagtatggcggacagagtatttcactttcccatctggcaccgttcgtacaggtcagccgtgaaaaataccgcaagcaggtccgcacggaactggaagcaatcggagtgacaccgactgaggataaagtcaataaaattgcggagatccgtgtgaaagaagagatcaaccgtggtgtgcagatgatccagtatcaggtgatcacactgatgacgacaaacggacaggcaccgtttatcacggtatttatgtatttggatgaggtaccggaaggtcagcttcgcgatgatcttgccgcagtgatcgaggagatgctccatcagagaatccttggtgtaaagaatgagcagggcgtatacattacacctgcattcccaaaactgatctatgtgttagaggcagataatatccgtgagggtaccaaatactggtatctgacaaaacttgcagcggaatgtacggcaaagagaatggttccggactatatttcagagaagatcatgaaaaagttaaaagacggcaactgttatacctgtatgggatgcagatctttcctgactgttgaccgcacaaaaggaaattatgcaaatgcaaaaaattacgttccgggtaagaagtattacggcagatttaaccagggagttgtcactttaaatctcgtggatgtcgcatgctcttccggaaaagatatggataaattctgggaacttttggatgaaaggttagatctttgttacagggctctgattatccgtcataagagactgctcggtacaccttctgatgtggcaccgattctctggcagaacggtgcactggcacgtctgaaaaaaggtgagacgatcgataaacttttatatgacggttattccacgatttctcttggctatgccggactttgtgagtgtaccagatacatgaagggggtttcccacaccgagccggaaggaacagagtttgcattaaaagtaatgcgccgtttaaatgatgcatgtacggaatggaaagaaaaacacaatatcgatttcagcctgtacggaacaccactggaatcaacgacttataagttcgcgaaatgtcttcagaagcgttttggcattattccgggagtgacggataagaactacatcacaaacagctatcatgtccatgtgacagaggaaatcagtgcattcgataagttgaagtttgagtcacagttccaggagctttctccgggaggtgcgatcagctatgtggaagtgccgaatatgcagaataatcttgacgctgtacttgcagtgatgcagtatatttatgacaatattatgtacgcagagctgaataccaagagcgattactgtatggaatgcggttattccggagagatcaagatcgtcaatgacaaggacggcaaacttgtctgggagtgcccgaactgcggtaaccgtgaccagaacaagatgagcgtggcgcgcagaacctgcggctacattggaacacagttctggaatcagggcagaacacaggaaattaaagagagagtgcttcatttataaaattcatattgcgaaaaagaaccgtatatcaacattgatgtgcggttctttttatgataaactgtaatggtactaaatcactaaaataaaaatttaactttggaggataaaatgttagaagcaggaatcaaaggacagcataccattatagtagagaaagaaaatacagcagcagtgatgaaaagcggtacgttagcagtattcgcgacaccggcaatgatcgccctgatcgaggagaccgcatggaagagtgttgcagatgaacttgaagaaggatgtgtgactgtgggaacgagccttaatgtaaaacatcttgccgcatcaccggtgggaatgaaggtgacctgcaataccactttagtggaagtggataaaagacgtcttgtattttccgtagaagtagaggatgagaccggaaaagtcggagaaggaacgcatgagcgttttattgtacaggcggaaaaatttcagaataaggcggatgccaagttaaatagataggaggaaacattgaatttagttatcgggttactggtcccgtttctgggaacttcgctgggggcagcatgtgttttctttatgaaaaacgggttgaaccgtctggtacagaaagcactgcttggttttgcatccggcgttatggtggcggcatctgtgtggtcgctgctgataccatccatcgacatgtcagagggaatgggaaaatttgcatttttaccggcagcaatcggatttatatttggaatcctgtttttactgctgatggacaaaatcattccgcatcttcatatgaatgaagacaaaccggaaggattgccaagtcacctaaaaaaaacaaccatgctggtactggctgttactcttcataatataccggagggaatggcagtcggtgttgtgttcgctggacttttatcaggaaacaacggaattacactggcgggagcattttcattgtccataggaattgcaattcagaattttccggaaggtgcaattatatcgcttccgctgaaaagtgaaggcggcagtacaaaaaaagccttctggtatggcgtggcatccggtgtggtagaaccgatcgcggcgggaattacgattattttagccggaatcatcacacatatgctgccatatctgcttgcatttgcagcaggggcaatgatctatgtggtcgtggaagagcttcttccggaagcatcagaaggagaacattccaatattaatacgattggatttgcggcaggttttctgatcatgatgatattagatgtcgcattgggataaaggaggaaataaatatgcaggacgatataagagaacagctgatcaaacagtttccatcagatgtggtagagatactggatcagagtggtaaaccatactatggctgtccgacctgtaagagggcagttacagtaggaactgataaatgtccgggatgcggacaggtgcttgcctgggatcatatccgcaaggaaaaccaaaaaaaggggacgatgacagcagtgttgaaatttgaggtggcaggcgattttacaaagggagactgcagaaaatgtccgctttcctacattgcaaaagaaaaaaatgaaaatgtttatgaatgtccgttgaaaatgcgtgcaaactgtaaacttgagcttatgtagaaaggaaattcatgcgcggtgtacagatggtcattatagcggtcggaggcattttattattctggttcttcgcgccgctgttatgcaaaggaatttttaatataggaacggcgaccgggattctgatctcgttattcctgttatgttatggaatttttttcgggcgtatgaacaggagagctttgatattgtggaatggcaggaaaacacactggatatgtgttttcctgcttgtccttgtacttataatgatcatgacagtgttggcagagacatttctgatgatccactcagcattacacactccgccgcaaaatacgacagctgttgttttaggatgcagtgtaaaaggtacaaaaccaagcagaatattagaggaacgtattgatgctgcatatgattatctgagtgtaaataaagatgcagtatgtattttgtccggtggcagaggaccgggtgaagatatcacggaagcacagtgcatgtatgaagtgctgacaaaacggggaatcagtgaaaatcgtctgattttagaagaacgatctacaacgacggaagaaaatttaaaatataccggagaaattttaaaagaccgtggacttgatatgactgtgacactggttaccagtgaatttcatgaatatcgggcgaatcagatggcagccaggctgggaatgaaaagttacagtaccccggcacatacattttttgtatattttcccacctattatgtgagggaactgtatggcattttatattatgaattgcgtcattgggattagtgtggaagtatttttataaaaacagtgcagtaataaaaagtggaatgtcagagagaggaaaagatgccaggaaaatattatgcagtaaaaaaaggaagaaaaccgggagtgtaccagagctgggcagaatgtaaagcgatggtggacggctttcctggagcagtatataagagttttaaaacaagagaagaagcagtggcttttgccaaagctgcgacatataccggagcagatgctgcgccaaagatgcaaaatgcaatgaagaaaacaatgcagcaggaagatggggcaatgccgtctgtctatgcgtttgtggatggttcttacaatgtggcaacgcatgtctacggatatggtggctttctgattcatgatggcataaaagaagtgctgcaggggagtgataaggatgcagagatggcagcgatgcgcaatgtcgcaggggaaatctgcggcagtatggctgcgatcagaaaagcggtcgaattaggattgccggaagtaacgatttattatgattacatgggaatcgaaatgtgggcaaccggtgcgtggaagtgcaataaaaaagggacagcagcataccgtgattatgtggcatcggtgagaaatgtgattgtgatccgttttgtaaaggtaaaaggacattccggtatcgatggcaatgaggaagcagatatgttagcaaagcaggcagtggggaatgagatataaaaccggaatccgggagcagatatatggataaaaagttaaaatattatgatctgatggaggacttaagaaaacagatcgtttcaggaaaaataaagccgggagaaaaactgccatcggaaaatgaactttccgggacatatcaggtaagcagacagactgtacggaaagctctgcagattcttcagaacgagggatatatttatgcggaacatggacgtggaacgttttgttcggagatggcgagacgcacgggtgaaacaaaaaatatagcagtggtcacgacatatctgtctgattatattttcccgagagtgatccagggaattgataaagtccttacggaaaatggatatagtattcttttaaagaatacaagaaattccagaaatatggaagcgaaatgtttagaggaactgctgcagaaaggaattgacggtctgatcatagagccgagcaaaagccagattttctgcaaacatatcaatttatatcagacgctggatgagtaccggatcccatatgtatttattcagggcagctatgcacagctggctgaaaagccgcatattctcttagacgactgccttggcggatatctggtcacgaaatatctgatctcactggggcaccatcacatcatagggatatttaaagcggatgatacgcagggacagcagcgccacaaaggatatgtgcaggcattgcaggaggcagggattgcatatgacccggataaagtggtatggttttatacggaagaccggaaaacacatccctatgagcagatgtatcatatggctaagacacggtgtgtgcatttttttgacagtgtggtatcctataacgatcagatcgcacttgaagtcatccgggcattagaagatgccggactgaaagtcccggaagatgtgtcagtgacggggtacgatgattcttatcttgcgtcaagtggaaaagtgccgcttaccacggtggcgcatccgcaggaaaaattaggtgaaatggctgcagaacttcttcttggactgctgaaagagggaaacatcccggagtcagaaagacagatccttgtaaagccggagttagtgatccgggaatcctgcagatcccggaaaaaggaggaataaaagatgaactatgcgcagatcaaaccctgttctattgagaatggcacgggcgtgagggtgtctttgtttgtgtccggatgcagacatcactgcaaagagtgttttaatgaggaaacatgggatttttcttatggtaagccttttacaaaaacgacagaggatgagatcgtgcaggcgttagcaccgtcctatattgcagggctgacgctgcttggcggagatccgggtgagccggagaatcagcagggactgcttcctctgttacagagaataaaaaaagaattgccggataaaaatatctgggcatacagtggatatctgtatgaggatttccttccgggaggaaaggtgtattgtgaggcgtcagagcccttcctgtcaatgatcgatgttatggtggatggaccttttattttagaaaaaaaggatatttccctgaatttcagaggatcttcgaaccagagaatcattgatgtacccgaaacgcgaaagaaccaggaaatcgtattactgatggaataaagaaaatgaaatggagagtagtgtgaaaaataagatttttcacacacaagatttgtgcttgcgcacaaacttgagatgccctgaggaacgggctagaaatggagagtaaaatgaagttttcatggagaatgattgctgcggcttttagttatgcattaggtgtattaggctggtgttatgtaggtggctataagatcctgaccggtccggtgagagaactgatccttgcacagatggcgggaagtatgtctttgggacgactggtggcggccctgatcgagggatttatatatctttcgctggcaggcggagtctggtgcattgggtatatgttaagtagtcatttcagggaagattgataaatacatagagaggaacaaaaagaaaaatggtttttagagtgccttcatattataagaattttcggtgtattgcggacaaatgtccggataattgctgcagaggatgggaaattgatattgacgaagataccctggattattataaagatctgaaaggaccgatggcagaaaaaatccgtgcgtcgatcagcgaggatggaagttttgtattgaatgaagagggatggtgtccgcttctgaatgagaaaggactctgtgaggtgtgtctgactttaggggaggattcgctttcagaagtatgcacagagtatccgaggtttacaacggagtatccgaaaacaagagaaaaagttttatgtctatcctgtggagaggttggaagaattgtcttttcagatacagaacagatcggatttgatgagcagatcctctcggaggactatgatgaatatgagtgggaagatggcgatgatgagcttgcagaaaaactcgaatcagtaaggtcgcatgcaatcggactgcttcaggatcgcagccgcccgattgcagagcgtatcgcggtgtatctgaattactgctgtcagatgcagaaagaattatttgaggcagtacccaaagaggaggaaccggaaaaaatcagcctgtatgaggcatttctacagcggctgtcccaatacgaggagcttgaatccatcggtgatgcatggtctgggatggaagaagagctgaaagctttttatcatgaagaaaattatgaaaagacacatcgtgctttcatggaagcgcagatggaaaatgaatatcagtatgaacatctgatggtatattatactttccgctattttatgagggcattctacgataataatctgcttgaaaaagctcagtttgcagttgcctcatttttgatggtgcgtgatatggatgttatggtctggatgaaaaacggacagaaatttgatttacaggatcgcatagaaacaacgaaagtttacgcaaaagaagtggaacattcggaagaaaatattgaaatgttaggggaatcatttttgtttgaagatgtattttccgtaaaaggtctgcttgcacagattatgtaaaaaataagccgggtgacagggcacctgacagctttcataagctgacggcctgatcaaccggcttttagtatctgcctgtgagaaaatgcaggaaagatacaggtttttttccagcagcttttgtctcgtcgatatatttctcatagaaagaaataacttcgcaaaaagacattgccggatcgattgcatatgtcatacaatacacctccttatttgttttctataatatagcacaatgcatcgggaaaaacaacaaaaaataatatgaaagattgtacaatatatacaaaaatgaaatgagtgaatgaaaaattcacaaaaacagaaaaacaacaagtgggtatttttactgatttttacagaataaaattgtataatattacttaagaaataaaaaatgaacattttttgccataaggaacaggtaaaataaaaaaattatacaaaatatttctgacctgggaaaaggggagaatatggaacagggagaagcagtccgcagacgtgaagcggaaaagaggaaaaacgaagcgagaagaagaagacagaaaaagcggaaaaggcagcagatgtttgcgcgcagtgtgatggttctgacaggaactgtatttgtgggcgttattttgtatgggggatggcgtctgtcccacaggacggcacaggcgcaggaagagatcgtggcagaggaaacgaaatatattgcagaccgcccggatttttctgtggagcttttagactacaatgaatattcaagaccgggaacggcactggaaaaagtaaacgggatcgtcgtacattatacggcaaatccgggaacaacggcacagcagaaccgggattattttgaaggactggcacaatccggggagacacatgcaagcagccattttgtcatcggaatcagcggagaaatcatccagtgtattccatgcaatgagattgcatatgcttcaaacgacagaaacagcgatacggtttccatagagtgctgtattccggatgatacgggaaaatttacggatgcgacttatggatcgctggttcatctggtaacatggctgatgggacgttatgatctgactacggatgatgtgatcagacattatgatgtaacaggaaaggcatgtccgaaatattatgtggaaaatgaggctgcatgggagcagtttaagtcggatcttgtcgattacatagagaccaacggtattgcaaaaacagaggaaatacagtaaaatgggtgtatcaattatgtcgaaggaagcagtatgatagagaaatattacgaagcattacaaaaaagagaaaacctccgcgaaaaccttgttgggctgcgtgcccagatcaaagatgaggcggcaaaagagcaatttgtatcgatgatcggggatggcggattgctgttagaattattagaggaagaagatccaaaggtgcgcaaaaatgtggcgatgatccttggggaactggaatggatgggggctgcagatgcacttgttacggcatatgaaagggagcagactctttttgtaaaaagcacgtatttaaaggcacttgcttatcttgacattacggcatatcaggaacggttcaaaacgagaatggaagaacttctttcttataccccggcagcagaagaaaaaaagcatattgatgaggaagtccgcgcacttggcagactgttggaaaaggcagaagaaagcacaggccacacttttacgggatttaaaaacccgcatgagatgctgctgctgacgggacatgcgcgtacggatgtgacattaaaggaaatcggggtacttccggcggatatccggagaaaaacggcgaaacatccgcttggagtggcagtgtatacaaaggatgtacgcgctatggcgaaccttagaacttaccgtgaactattgtttccaattcgtttaaaacaggaagcagaacaggcagaagtgctggcggatgaggtgtggcagagcggtattggggatttcttaaaggagtgtcataagcagggtacgccgtttcggttccgcgtggagatccgggctgatatggagaatgacaaaagagcttcttttgcgaaaaagtttgcgatacagttagagcgtgtgtcggcgagatggctgatcaattcgaccggtgattatgagacagagattcgtctgataaagaaaaaagatggaagttttgcaccatttttaaaattgtataccattccgatgcgacgtttttcctaccggaaaaatgtggtggcggcatctatccatccatcacttgcagcgatgcttgtatcgctggcaaaaccctatctgaaagagaacgcacagattttagatccgttttgcggagtcggcacgatgcttattgagagggacattgcacaaccggcaagagaaaagtacggaatcgatatttttggaccggcgatcgaaggcgcaagggagaatgcctcattagcaggggaaaagatcaattttatccatagagattattttgattttaaacacgattatctgtttgatgagattattaccaatatgccggtgaggggcagacagtcgcgcggtgagatggatgcactttatgcttcctttttcgaaaaatcaaaagaaatcttaacaccgggtggagtaatgattttttattcgaatgaagaaggcatggtaaagaaacatcttcgtttacattcagaatacaggctgatacaggaatttgtgatttcggaaaagcgtcattttagtctgtatatcgttggaataaaggggtagagggaaatggcatttttgagcaggaagaaggaagaggatgctttgaaatcagaacagatacttttggatgcaacactgatgcagaatctgcaggatcggttttgcgacgcaaataacctgtatttaagatgtcttgacaaaaatcgcacggaagtgacgaagacatatggttcaaaggaagaacttgagtatctgggcagtgtgatcgacatggacagacatatcggactgttagagaggctgttaaacagcaggatcgaaagtgtgatcgaagaggattgtggggcagacgggatccggatgtgtggagtggcagtaaaggtaagtggagaggtgtctgcgatctggatcgtgaccggcgttatggaagatgccggctgcgatgtgccggattatattatgcggacaacaccggaacgctattataagtcgatcgagtttttagagacgctgtcaaagcagatgtttgccgtcaaattagaagaacttttggcgcaggaggcatttttaaagagccgggagtcggaaatacagatggagacggaattaaaacgcaatgaggcgatgacggcaatcgtccgtatgctcgagtcggaggagggttttgataagattgttcatgatatcttaaaagaagcatgtgagtatcttggaatttcagcggctgttttattccgggaaaatatagacggcacgacggtcaacatgatcagcgagtattgttctgcgggaagagaatcacggatggaggcatcacagaacatttcaaaagaagaactgccattttttaatggaaaaccatatatgatttcggcagattcaatgatgccggaagcgttccgcagaatgtttgaagtacagaagatgaaagccgggttattccttccaatcgacgtcagcgggaaaacgggaatgtacgtctgcttttgcgaggatgaaaaagagcgcatctgggacggcggagaaatcaagtttgtcaatgatgtccgaagaatcatacagacgattctggtaaaacgcattgcaaaaaattcacttgccagttcgtatgcatcgttagaagcaatccttgaaaatgtgggatgtgggatctatgtgatggatacacaggaaaatacgatcctgtatacaaaccagcactttcgtaaagcatttggggaagatgtgcgaagtgcaggtattgaggaatgtttaagacagggagcgcaatcggaggacagcctgtatttcagggaggtttattcgaaagaagaaaaccgctggtttaatctgcacagtacaaggattaactgggtggatggaagaaaggtccttttgtgtaccatttatgatgtgacagacaaaaagctgtatcagcagaagattgagcgtcaggcaaacaatgatttcctgaccggattgtataaccggatgcgctgtgaacaggatttagagcgttatatccgtcagacgaaggagtttggcggtgagggagcgctgctttacatcgatctggatgattttaaacatatcaatgacggactcggtcatcagtatggagatgtgctgcttaagaatatttccggcagtctgcagagaattcccggtgtggagaataactgttaccgtatgggtggtgatgagttcattatcatattggcgcatcatcatatggcgatgctccagcagatcttagatgagatcaaggcgctgttcacgaaaccgtggatgctaaaagggacggattattactgtacgatgagtatgggagtcgttcgcttcccggcagacggggatacggtggaagaattgatcaagaaagccgatattgcactttattctgcaaaatgtgcaggaaagaaccgtatcgagttttatgatgacaacgtggagtccacctcttacaaacggcttgaccttgaaaaaaacatgcgcaatgccacacgaaatgctttcagtgaatttgaggtatatttccagccgattgtaaatattacaaaagagggaaatccatgtgccggtgcggaggcactgatccgctggaattccggcgaactcggtctgatcccgccggcagatttcattccgcttgcagagtatttaggcctgatcaatccgatcggagaattcgtcctgcgggaggcatgtatccactgcaaatactggaatgatatgggacacccggagtataaggtgaatgtcaatctgtctgtcgtacagcttttacagaacgatattgtggagcggattgcgcatgtgatcgaggagacgaggatcaccccacagaatctgactctggaagtgacggaaagtcttgcagtcaacgatatgagccgcatgaaacggatccttgcggatatcaggcatcttggtgtgcgtgttgctctcgatgatttcggtacgggatattcatctttaaaccatatcagggagatgccgatcgatgtcataaaaatcgaccgctgctttatcattgatatcggaaaagatgatttctccaatgcatttgtaaaaatggtcggagaacttgcaacagcgatccatgtgaatgtctgtgtggagggcgtggagacaaaagagcagttagatgcgctgatgggctcaaaggttcagctgatccagggattctattttggaaagccgatgaaggcggaaatgtttgagagacagtacctgtaagggtactgtcttttaatgttaaaacaattaaaacagttccaaaaattaaaaaaataaataaaattaaaaaaatatcaaaaaactgttgacatatttatttttatctgttattataaatgagtcgtcgcgagagagtgattgatacgcggaagtgtcggaattggcagacgagcaagactaaggatcttgtgttcattgcgaacgtgtgggttcaagtcccatcttccgcatcaaaagatttctttgaatgacggttcgcaggagtggcggaattggcagacgcgcaggcttcaggtgcctgtggtagcaatatcgtgtgggttcaagtcccatctcctgcattttatatgttgagatgagagaagcactgaagattcggtgctttttttgctttataggattcgggtgccaaaaattgaaagccaccttttggcacccgaatctttagtaggaaatttctcatctgagaaaattaaaatccgtgaaaatagtatccaagcgcggcagaaaaaatgctgcgctgtttgcatttatgaggaaatcatttataatagatagcaatgcggtgcagaatgcaaaaacaaaggataaaaaaatgattacgttaaatgattatctttattccggagatacggtattccggattttaaaaaaatattcagaagatctaaaacgtgcggcagaggaaaatcagagtgaagtggatttgttacattattatttcctgctgcagatcatggagttgttagagcacaatgatttcctgacggcacaatcacagaaaatccgggagttttatcagtatatggcaaaacagtatccgtatctttcttttacatttaaagggcggatcaaatcgctgatccgtgcggaggcaaaatttaacggctatattgtggcgtatgtgtatgattattatctgaaaaatcacgcatatccgcccgtggacgaattaaaagagcggctgacccgtttcagggatctgatcgcttaccgcattgtgatatccatgcccaaatgtcatgtgagagatgaaagggaaagagaacaggaagaaatcaggcatttatatgaaattgcaaacagactgaaggtgtttttggaggagcgggggtttacagcggaaccggcaggaggcgtaaaactgagtgattccccgttactgaatgaagatgtgcggccatattacagagattatatcgtgaacgaagaatccgatggataccggtcactgcatattaccttttttgataacagtgcacattgttatgtggagatgcagcttcggacaaaaacgatggatgatatcgcggagatcgggcctgcgaaccatctgggatatgagaaaaagcaggagcgtgagcgtgcaagacgtgatgttattccggtgggagaatgcatttattttgatgaggcatatgaaagaggaatgaaactgcagcagcttgaactgccaaagctggatgtgaatatgttcgcagcgattgacaacagtctgatcaatgatggctgtgggctttatcgtggcagactgatcctgccgtacgagcacttatcacgttttcagaatgattaatgaaaaaataacaaaaatttgtcagtaatttgtaataaaaaaaggaaatcggaaaagaacgcggaatatatatattgtaattactgtgtggcaggttatccaaagaggaggaacaacatgtcgatacgggaagatattgaacggatggaatgtgagactttaagtccgtatgctacgctcagtatacattcaagaggacgtgatgatccggaggagcagtgtgatataagacctgtattccagcgtgacagagaccggattttacactgtaaggcatttcgccggttgaaaaataaaacacaggtgtttctgacgcccaaaggggatcattacagaaccaggctttcccatacattagaggtgtcacagaatgcgcgcacgatcgcaaaggcactgcggctcaatgaagatcttgttgaggcgatcgccttagggcacgatctggggcatacaccgtttgggcatgcgggagagtttgtgttaaacggactttgtgatgagagcttccatcacaatgaacagagcgtgagaattgtggagaagttagaaaaagacggtaagggactgaacctgacctgggaggtaagagacggtatcctaaaccaccagacaaggctgatgccgcataccttagagggaaagatcgtccgcctgtcggataagatcgcctatatcaaccacgatattgacgatgcgatcagggcacagatactgacagaggaaaacatcccattagagcttcgaaaaacactgggattttcgacaagacagcgtttaaacacactgatacataacatcatcagcaacagcgttggaaaagatgatatcatcatgtcagaggaagtagagcaggctatgatcgaactgcgcaaattcatgttcgatcatgtctacaaaaatcctgtggcaaaaggggaagagacaaaggcaaaagcaatgatcgagcagttgttcttctattatatggaacatatcgagcttctccctgagaaatatctgcgcatgcgtgatgccggtgaaacagaccagcgtatcatctgcgattacatctcaggcatgacagatcagtacgcgatcacgaaattcagcgaatattttatgccgcaggcatggcaagtagatggttattagaaagtaaaaagtctgcggcatgccgcatggcatggcaagtagatggttattagaaagtaaaaagtctgcggcatgccgcatggcatggcaggtagatggatattaatacgaaaggagaaaaagatgccgtattattctgatgacatcatagaagaagtgcgttccaggaatgacattgttgatgtgatttcccaatatgtgcgtctttcaaaaaagggcagtacctattttggactctgcccgttccataatgaaaaaacaggctccttttccgtgtcgccgaacaagcagatgtattactgcttcggatgcggcgcgggtggaaatgtatttacgtttctgatggagtatgaaaactttacattcggcgaggcgatggaagcgttagccgaccgtgctggtgtggaattgccgaaacaggaatacaccagcgcacagaggcaggaagcagacaaacgagcaagactgcttgaaattaataaagaagcagcaaagtatttttacatgctgctgcgtggggagagaggtgcgcgtgcgctttcctatttccgaaaacgggaactgtcagatgagaccatgcagaaattcggtctcggctattccgatcagtacagcgatgatctttaccggtatcttcggaaaaaaggatatgaggatgacatcttaaaagaatccggtttggtcagcatcgatgagaggcgcggcgggtacgataaattctggaaccgggcgatgttcccgatcatggatgtccacaacaaagtcatcggttttggaggacgtgtcatgggggatggcgagccgaaatatctgaactcaccggagacaaagatctttgataagagccggaatctctatggattaaattttgcaaggagtaccaagaaaccacagcttcttctgtgtgagggttatatggatgtgatcgccctgcatcaggcagggtttgacaacgcggttgcatctttaggaacggcgctcacaagtggacatgccaacctgttaaagcggtacacaaagaatgtttatctgacctatgacagtgatggtgcaggtgtgaaggcggcacttcgtgcaattccgattttaaaagaagtaggaatcaccacgaaggtcatcaatatgaagccttataaggatccggatgagtttatcaaggcgctcggtgcagagaaataccagaaacggatcgatacggcggaaaacagttttatgtttgagatccgtatcttagagcagcagtatgatatgcatgatcccgagagcaagacaaagttttacaatgcagttgcagaaaaactctgcacgttcggagaaaaattagagcgtgataattatattgctgcggtagcagataagtatatgatcggtatcgaagatctgcgcaggctggtcaaccagtatggtgcaaagatcggcatggcggcaggtggagcacctcctgtgcgtgaaagatcggaactccggagagaacagggcagcgaaaagaaaaaagaaaacggtatgatacagtcacagaagctgcttttgacctggctgatcgaacataccggactgttccctaagattgagaaatatatttcgccggaagatttcacagaagaaatttatcacaaagcggcggaaatattatatgaacagtatcggaataccggtactgtcaacccggcaaaaattgtcagtatgtttcaaaatgaagaagaacagcgcgagatcgcaggtctttttcatgccacgatccgcggcgtagagacagaaggagacaaagaaaatggtgggtattccaaagaaacgtttgaaaaagcgttaaaagaaactattgtccgggtaaaacaaaacagcattgagtatcacctgaagaacatggcaccgaccgatatggcggcgctgcaacggtcagtggcggataagaaggcacttgaagaattagagaaagtgcatatttccattgattaaggacaaaatagtagaaaacctgagaggatgaaacaaaatggcaacaaaaaagaaagaaaacaacgaaaatacgaaggtttccggaaaaaaagcggagacatctgcagtaaataatgcggaagcagaagcagcaagagaaaaatttcaggaaaaattaaaagagctgttaagtctcgcaaaaaagaaaaaaaatatgttagagtatcaggaaatcagtgatttctttgcagatatgcagcttgactctgataaatttgagaaaattcttgatttccttgaggcaaataatatcgatgttttaagaatcacagatgatgatgcggatgatgacattctgcttgaagtggatgatgatgacgagatcgaggtggagaagatcgacctttctgttccggacggtgtatccattgaagatccggtgcgtatgtacttaaaggagatcggtaaagtgccgctgctttctgcagaggaggagatcgagcttgcgaagcgtatggaacttggtgatcaggaggcaaaaaaacgtcttgcagaggcaaacttacgtctggtagtcagcattgcaaaacgttatgtgggacgtggtatgttattccttgacctgatccaggagggaaatcttggtctgatcaaggcagttgagaagtttgattaccgcaagggatataaattctcaacttatgcgacatggtggatccgtcaggcaatcacaagagcgattgctgatcaggcgcgtacgatccgtatcccggtacacatggttgagacaatcaacaaactgatccgtgtgagcagacagttactgcaggagttaggacgtgaaccgaccccggaggagatcgcagcagagatgaacatgccggtggaacgtgtgcgtgagattttaaagatttcacaggaaccggtttccttagagacaccgattggtgaggaggaggacagccatcttggagattttatccaggatgataatgtacctgttccggcagatgccgctgcatttacgttattaaaagaacagttagaagaggttcttggcacactgacagagcgtgagcagaaggtacttacacttcgttttggccttgaggatggacgcgcaagaacactcgaagaagttggaagagaatttaatgtcacccgtgaacgtattcgtcagattgaggcgaaggcactgcgtaagctgcgtcatccaagcagaagccgcaagttaaaggattatctggagtaagatggtaaagatatcagacagattaaaaacggcggcttcgttgatccgggaaggtgcggtgcttgcagacgtggggacagatcatggttatgttccaatctacctgttagagcaaaagaagatcaagagcgcgatcgcaatggatatcaataagggaccactggaacgcgcaagggaacatattcatttatatggtatggatgcatacatacagaccaggctttcggatggagtcgcagcactggaaaagggcgaggcagactccatactggttgccggtatgggtggcgggcttgtgatgcatatcttagaagaaggaaaagatatctgtcaggcggcgggagaactgatcctgcagccccaatcggaactgtgcagtgtcagggagtatcttgccgaaaatggatatgtgacggaagcagagcgcatggtatttgaggatggcaaatattatccgatgatgcgtgtacactatcaggcagagaaaaacgaagatgcagataaaacaataaaagatatggaaaacagtaaagagcagaaaaaaagcagatataaggtcgaatgtttatacggcagatatctgcttatggaaaaaaatccggtactgcatcaatatctggtgaaagaacgccaggtgtttgaaaacattctggacaatctttttaaacagcctgaatcagaaaaaatagccgtgcgcatggaagaggtaaaagaagcgcttggttataatgaagctgcgcttgcatattatagaacgtgagctgtcattgatggaaacgaggctgcgtagaaaagccggtttctgtcagaaggggcggacaggaaaaatgacagcaggcgaagagaatggagaccttgtatatgggagaagaacagatcgttgtaaaaatcggggagaaagaaaaaacatatccggcaggagtcagtttcttaagtatagcacaggaatatcaggatcagtatgaggatgatatcgtgcttgcactgtataataacagactgcgcgaattaaaaaagaccgtaaaaaaagacggcgaattgtcttttcttacaacgtctgataagaccggaaagcgtgcataccgcagaagtgttacgctgctgatgcaaaaagcagtttacaatctgtggggcagagagcatattggcgtttatgtcagatatgccatcggtcagggatattactgtgaactgatgaaagacggggaaagctgtaagatcacggagacaatgatcggggcattgaaaaaagaaatgtaccgtcttgtgatggcggacctgccaatcgaaaaatacagtatgaatacggatgaggcagtagctttgttccatgaacttggaatgaaagataaagaaaaactgtttcgttaccgccgcagttccagggtaaatatttacgaactggatcattataaggattatttttacgggtttatggtaccgtcgaccggatatttgagatattacgatgtgacagcatatcaggatggttttgtacttttatttccgggaaaagaggcgaaaaaagtttctgaatttgtgccgtcggataaattatttttcacgttaaaacgttcaagagactggggaaaactgcagcagattgatacgatcggtgcactcaatgatgccattgcagcgggaaaaacgcaggagatgatcttgacacaggaagcattgtttgaagagcgtatcggtgcacttgcagaaatgatcgttaaggaagagggaaagaaatttatcatgatcgcgggaccttcttcatccggaaaaacgactttttcacaccgcctgtccatacagcttgcagcaaagggattaaaaccgcatccgtttccgcttgatgactattatgtggatcgtgataaatgtccgcgtgatgaaaatggtgaacttgactttgaatgcctggaatcactggatgtagagcttttcaaccatgacatgaatgaacttctggcaggaaaagcagtcaatctgccgatctttaattttaagaccggaaaaagagaatacaaagataagatcatgcagttaggaaaagatgatgtgttagtcattgaggggatccatggactgaatgataaattgtcctattcccttccggtggagagcaaatttaagatctatatcagcgcactaacacagctaaatatcgacgagcacaactatctgccgaccacggatggaaggatgatccgccgtattgtgcgcgatgcaagaacaagaggtacctcagcgaaagaaacgatcgctatgtgggattccgtgcgccgcggtgaggagaagaatattttcccatttcaggagggagcggatgtgatgtttaattccgcattgatctatgaactggcagtattaaagatatatgccgaaccgctgctttttgcgatcgacaaggactgtccggagtaccttgaggcaaagcgtctcttaaagttcctggattatttccttccgatgtctccggatggaatcgggcagaattccattatccgtgaatttatcggcggttcgtgttttaatgtgtaaaacatggaaaaaaccttgcctcggcaggactaagagaaaataagaaaatcaggcttgcacaaataagaaaaaaagtgtatagttaatcgggtgtcatgctggcagaatgtgccggaagacaaatgatggatttaagtaggacaaatgatcgcggcccgtttatcggggtgaggaaagtccgggcttcacagggcaggatgccggataacgtccggtagaggcgactctaaggatagtgcaacagaaatataccgcccggtatatgccgggtaagggtggaagggcagtgtaagagactaccgcctctctggtaacagagggggcatatgtaaaccccatccgaagcaagaccgaacaaaagcgttgacgtggcccgccagctttaggtaggttgcttgaggcggctggtaacagtcgtcctagatagatgatcattccgactgtggcttgctgcagtttagacataacccggcttatcgtcctgcttaaatcagatatcaatagataagaagatatccatatgtggaaatataaccaaaatctaaaatgtttcttaaaagacaataggaatgttgacgtttgtgagtattgggtttaccatagcgtcatggacaaaaaacggtgccagaaaggtgccgtttttccgtacataaataaaaatgcgattgacgggatacatgcagttatataaggctgcatgtgattacacgcggttgtatctgggtagaaagggatgtcatagatgaaagaaaaattacgacagtttatgatcggcagatatggagtggacgatctttcacgggcacagattatcgtgtcgatggttctgttacttgtatccacatttttatctgcatttttccgggtaaatattttatactggcttggcctcgcattgttaatttattcctatttcagaatactctcacggaatgtgtcaaagcgttacgaagagaaccagagatatttaaatgcgaaataccgggcagtggtaaagaaaaacaatctgaaaaaacgctgggcacagcgcagtacttaccgtttctttaaatgtccgcagtgtaagcagacagtcagggtgccgaagggaagaggaaagatctgcattacctgtccaaaatgtaaaacagaatttattaaaaaaagctgacaaaggagaaaggccttgtgtttggttatatcaatatcaatcaaaaagagctgacggaagaaggcaaaaaagcatatcaggcatattactgtgggctttgcagacaactgaaatcaaattgtggaaccaagggacagatgctgcttgcatatgatatgacgtttctgattgttctgctgaccggtttgtatgaacttccgaatgaaaaaacaaagtttacatgtgcgctgcatccgacgcagaagcgtattgcatggatcaatgacgccacaaaatatgcggcggatatgaatctgatcttagcgtaccacaatctgattgacgactggaatgatgacaggtcgtataccaagaaggcatttgcaaaaatgctggataaggattatactcgtatcatgtcaaaatatccgagacaggtaggtgccattgaggaatatatgaaaaagactggggatgttgagaaacaccaggagacaaatcttgatctcgttgccggtctgaccggagagatggttgcggaggtgttttgctggaaggaagacgaatgggcagaggaactccgcacgatgggattttacatgggaaagtttatctacctgatggatgcgtacgaggattatgacagggataagaagaaaaactgctataatccgctcacatttgttcaggaagaacaggcgcaggatcttgatacctggtgccggctgcttttgacaagtatgatgtcagagtgtgcgaaatcgtttgagcgtctgccgattcttttgcatgcggatattctgcgcaatatcctgtattcgggtgtgtggtcgaaatatgaatatctgcagatcaaaaaacgcaggattgaggaaaaagcaaagaaaaaagagcataaacaatgaggtttgatttatgatggatccatatcaggtacttggtgtgtcacgaagtgcctccgatgaagaaataaaaaaagcatatcgttccctaagccgcaagtatcatccggatgccaatgtcaataatccgaacaaggcacaggcggaggaaaagttcaaagaagtacagcaggcgtatgaccagattatgaaagaaaagcagcagggaagcggctatggatataattcaggaaacagttacggatatgggggcggacagagttaccattataatcagagtactgaaaatccgaagctgcaggctgctgcaaattacatagcaaaccgctgttatgcagaggcacttaatgttttaaacggaattcctttttctgagagaagtgcacgctggtattattacagtgccatggcaaatcagggggcaggaaataatatcatcgcaaaagagcatgccgcgcgtgcagtggagatggaaccaagcaattttgaataccggcagttcctgcagcatttagagtatggcggaacatggtatacgaatatgggaagcagctatgacagaccttattcgagtgcgggtaactggtgtcttagcatgctgtttttaaatatgctctgtaactgctgttgtttaaggccgttttagaagacgggctaaagtctgaccacagaaaaacataaaatgctggaacgaaaaatactgccggatcgatggaaccggcagtattttttgttccagtattttattgttaacggcggtttggatttgtatatttctcctcacagtatttgcagcggtatatttctttttcagggtcagtcagaatgaaaatctgatctagttcctgttcgattgaagtgatgcagcgtggatttttacatttgatcacgtttttgacctgctttggaagacgaagttcttttttggagacgatcttgtcattctggatcacattgacggtaatattatggtcaataaagcctaaaatatcaaagtcgagtgcatcgatcggacattctacctttaagatgtctttttttcccattttgctgctcttggcatttttgatgatcgcaaccgggcagtcgagctggtctaatttcaaatcatgataaatctgcaggctcatgcctgcctgaatatgatcaaggacaaatccctcatggattccactgatatttaacattattctcctccttattcaaccttaatttcaagcagcgttaagatcagcgccatgcgcacatagacagcatactgtgcctgtttgaaataaacagctctcggatcgtcatctacttctacggaaatttcgttgacacgtggcagcggatgtaatacgatcatgtcttctggagcaagctccatttttgctttggttaagatatagaaatcttttaagcggacgtaatcctcctcattgaagaaacgttccttctggactctggtcatgtagaggacatcaagctgtgggatggcatcctctaaacgctcaacctcggtaaaaggaatattgttggcacgcaggacatcttcgcggatatagcttggaatacgcagttcttccggtgagatcagtacaaatttaatgcctggataacggatcagggcactgatcagggaatggacggtacggccaaattttaaatcaccgcagagtccgatcgtcatattgtcaagacgtccttttaaggaacggatggtaagtaaatcggctaatgtctgggttggatgctgatgaccgccgtcaccggcattgataactggaattcttgatttctgggaagctacgagaggtgcaccttcttttggatgacgcattgcgcagatgtctgcgtaacaggagataactcggattgtatcggaaacactttcgcctttggatgcggaactggaatcagcactggcgaaacctaaaacagaaccgccaagatttaacatggcagcttcaaaacttaaccgggttcgtgtacttggttcataaaaacaggtggctaattttttgccttcacatgcgtgtgcatatttgttcgggtacttctcgatatcattggcaaggtctaaaagcctgtctaattcatcgacggagaagtccaatgggctcattaaatgacgcatataaatcctccttatgtgatgctgacttttttcagcattttttctatcatataataatcaccatctgatttcaagaagaaaaaaatttacgttatattgataaaatatgcgtccgttttcagatattttcagacagggaaggttatatatcagtaattgaaaataaaaatttcagggggattccgaggtgttacaccggatgagaatgcgctcaaataaaagtccggcagccatccacaagggagcataatcgagtcgtatgaccccgtctatgtttgttttggcatgactgtaatcccaggggcacatgccgtggcgttttaaaaatgtgccgctgatgtattcaaaagaaaaaatgccaacggaatagatacagccgcgaagaagtgccggaagatttttgatactgtggtacaacggtgcaattacggcagcagtcccgtagatgggaaacatccatacggatgtccgcccaatcagacgtttatcctgtttcaaaaaagagcctgtggaggtaaaaagaatctccatgcaccagccggtcagtccgcagacaaagaagttttttgtaatcatatttgcatgtcccttttatataaaatcatggtatcagtatgtcacacggaatttaaaaatatgtaatatttttctaaaataaaagcggaaaacttgtaaaaacaggcgttctgtcatataataaaaaaagtgtattcttgaggaaagagaatgcggttagatcaattactcaaacatttttcatacgaaagcgtgcaggggagccacgaccttatcattacggatatctgttatcattccggaaaagtaaagcgggggtccctgtttgtctgtataaaggggcagtacacggatggacatgattatattatggatgcggtaaaagcgggggcatttgcagtggtggtggatgaaagctgtatggtaaatgtccgctgggaatgtttcatttacacagaacatggaaaagtgcgcgtgcatgaactcgtgcgcaattacggtatggctgtgataggtgtgaaggataccaggcaggctcttgcgcagatttcggctgcattttacgattacccggcaaaaaagcttaagatcatcgggatcaccggaacaaaaggaaagacgacgacggcgtttcttacggcaggaattttaaaagaagcgggatacaagaccggcatggtaggtacaatatggacatataacgggaaagatgtaaaaaaggccggacatacgacaccggaatctagcgacctgcaaagagaattagcgcagatggtaagcaacggatgtgtgtgctgtgtgatggaggtatcctcacagggaatcaagatgcagcgtgtggaagggattttttttgatatcggggtgtttttaaacattgaaccggatcatatcggaccgggagaacacgcatcatttgcagagtatctgtactgtaaaagccggctgcttcggcagtgtcaggcaggaattgtcaaccgtgatgaccggaatacggaaaaaatactgtttggtcatacctgtgacatagaaactttttccgtgctgggagaaaacggtgtggatgccccgggacaaaaggcggatatcgtggcagaaaggatcactttttccatgaaagaaggaaggttatacagccacttttttacggatggaaaagaagaattcctattgcagatgcccggaatttttaatgtttccaatgcgttagctgcgatccttgtggcacgtcattttaaaatagcacaggatgtggtaaaggatgcactgcaaagacagactgtgccggggcggtgtgaaaacgtcagaatatcagataaatttgtatttctggtcgattatgcacacaatgagatgagcctgcgcaatctgcttggaacattgcggggctttgatccggggcggcttgtcgtgatctttggctgtgggggcaaccgctcaaaattaaggagaggcaggatgggtgagacagcgggaagactcgcggattttacgatcctgacatccgataatccaaggtgggaagatccggaactgatcttagatgacattgagagcgggataaagggtacgagaggggcatacatacgcattgctgaccggagagcagcggtggcatatgcattcggtcatgccagggagggcgatattatcgtcctcgcaggaaaagggcatgaggactatcaggagatcggtggtgtccgttatccgatggaggacaaagaactggtaaagaaagcagcagaaggacgtggcagatagaaagaaaggcatggaaattggaatggcagaatatgcaaatatcattgtggatatttatcagggaaaattagataagacgtttcaataccgggtgccggagagactaaggagtacaatcgcagttggtatgctggtagcagttccgtttggatcaagaaaaatgcagggttatgtgatcgagctgacggatgtctgcgagtatgaggaagataagatcaaagagatcctttcgattgtaaagggcggtgtcctgatcgagtcgcagatgatcgcccttgcaggatggatgagggaaaactatggcggcaccatgaatcatgccttaaagacagtactgccggtcaaagaaaaaaagaaggcaaaagaacagaaaacgataagacttgcactgcatccggtcgaagcgaaaaatgagcttgcggaatgcgagagaaagcataaaacggcaagggcaaaacttcttgtggcattgttagaacagcgggagttagagtgggagacggcaacgcagcagatgtctgtttccgcgtccgtgattcgtgcgatggaggaagccggtattgtaaaagtggtgagtaagaccgcataccgcaatccggtcggcggtcttgatccgggcggggaacaaaagaagctgaatgaggagcagcagaatgtcgtctcgaaaattacgatggagtacgatgcaggtgagcggaagacttacctgatcaagggtgtcactggaagcggaaagacggaagtctacatggaactgattgcacatgtgcttgcgcagggaaaacaggcgatcgttctgatcccggagattgcgctgacctatcagacggtgcggcgtttttacaaccgttttggtgcacaggtatccatcatcaattcaaaactttcggccggggagcggtatgaccagtttgaacgcgcaaaaaacggagaaatttctgtgatgatcggaccacgttcggcactttttacaccatttccggcgctgggaatcatcatcatagacgaggagcatgaggcttcctataagagtgagaccgtgccaagatatcacgcaagagaaaccgcaatacagcgggcaaaaatgacagatgcggtcgtggtgctaggctccgcgacgccttcccttgagagttattataaggcagaaaatggcgagtactgcctgttggaattaaaacacagggtacaaaagcgccccatgcctttgtgtgagatcatcgacctgcgcgaggagttaaggaggggcaaccgctcgatcttaagtgaccgtctgagtgagctgatggaggaccgtctgaaaaagggagaacagacgatgctttttatcaaccggcgcggtatggcaggctttgtctcttgcagagcctgcggtcatgtgataaaatgtccgcattgcgatgtttcactgagccagcatggaagcggcgcggcgacacgtctagtctgccattactgcggatatacgacgatacagcccggtttgtgtccggtctgtggctctaagtatatcagtggttttaaggcgggcacgcagaaaatagaacaggtggtaaaggcgcgtttcccacaggcgcgtgtgctccggatggatatggataccaccagaatcaaagatgggtatgagcagatattatctgcattttcaaatcacgaggcagatatactgatcggtacacagatgatcgtaaagggacatgattttccgggggttacgttagtgggtgtgcttgcggcagacctttcactttatatcagtgactatcgtgcgtcagagcggactttccagctcctgacgcaggcggcaggacgtgccggcagaggtgacattcccggcaatgtcatcatacagacgtatgatccggatcattacagtatcacgactgcaaaagagcagaactatgaggctttttacgggcaggagatcgagtaccgcaaaatgatgcggtatccgccggtgtggaacatgctttatattttgtgcgcgtcgaaaaacgaggcggcagcaagtgaggcggcggtggcattgatggggaaaatcgatcagatagtgagagaaaacagtgaaaagattttttcaatcgggccgtcagatgcaccggttgcaaaaatttccgatgtctaccgcaaagtgatctatgtgaaaacccgagagtatcagacgcttgtcatattgaaagatggtctggaagcttttataaaagacaaccgtctgtatcagaatgtagcagtaggatttgactttaacccgatcaacggattttaaaattgtaaaatacaaaatggaggataaaaaaatggcacttagaacaatcagaatacagggagatcctgtacttaccaaaaaatgcagagaaatcaccgaaatgacaccaaagatcaaagaactgatcgacgatatgcttgataccatgtatgaggcaaacggagtcggacttgcaggaccacaggtcggtgttttaaaaagaatcgtagtcatcgatatcggggaaggcccggttgttatgatcaatccggtgattctggaaaagtcaggcgagcagaccggggatgagggctgtttaagtcttccgggaaaagcaggtaccgttacaagaccgaattatgtgaaggcacacgcgtttgatgaaaatatggaagaatatgagatcgaggggaccgagcttatggcacgtgcaatctgtcatgagttagaccaccttgacggacatatgtacacggagatcgtagaaggaccgttacatgatgtaacttatgatgatccggaggaataaacaatgagagtaattttcatgggaacaccggatttttcggtggggacattagaagagatcataaaagccgggcatgaggttgtgctggttgtctcacagccggataaagcggtgggaagaagtaaggcattaaaatatacgccggtgaaggaatgtgccatcgcacacggcattgaggtctatcagccggagcgtgtcagggacagcgcatgtatcgagtatctgaaatcgttccatgcggatattatgatcgtggtggcttttggacagattataccaaaggcagtgttagacatgccaaaatatggctgtgtgaatgtacatgcatcgctactgccaaaatatcgtggcgcagcaccgatccagtgggctgtcatcaacggcgatccgtataccggagtgtccacacagcgcatggacgaaggtgttgatacgggagatatcattttagaagaaaaagtggagatccggccggatgagacaggtggaagtttatttgaccgccttgcagaggttggagcagaactctgcgtaaagacgatcgaagcaatcgaaaatggaacggctgtttacacaccacaggataacagtaaagccacacatacagcaaagatccataaagagttgggaagtattgactggacgaagagtgcgaaagagatcgaatgtctgatccgcggtttaaatccgtggccaagtgcatatacgagacttgacggaaagacacttaagatatggagggcaaatgtgctgccggatgaaaagaaagcggctccgggatgcatcataaaagcggaaaagggaagttttctggtacagacaggagacggtgtcttagagcttcttgaggtacagttagaaggaaaaaaacgtatgaccacggatgcatttttaaatggctatacggtggaagagggaacttattttacacgtggttaatgaatggaggtaacctgatatgccttattactattatggttttgatccgacttatgttttggttctgatcggcgcagtgatctgcctgatcgcatctgcaagagtaaagagtactttcaataaatattcccggtaccgcagtatgagcggtatgaccggggcacaggcggcggaacgtattttaaattcagccggtatctatgatgtgacggtctgccatatatcgggaagtctgaccgatcactacaatccgtcaaaaaagacactgaatctgtctgactccgtatacggaagcaattctgtcgcagcgatcggtgttgcagcgcacgaatgtggacatgcgatccagcatcagaaaaactatgtgcctctgacactccgcacggcgatcgttccggttgcaaacattggatctacacttgcatggccgttaattctgatcggtctgttttttaaccgctcaaccggtgcaatgctgatcaatcttggaatcttatgtttttcatttgcagtattattccagcttgtcactcttccggtagagtttaatgcttcacgccgggcactccatattttaggtgagcagggaattttatcagacagtgaactgccttataccagaaaagtattgaaggctgcggcattgacctatgttgcaagtgctgcggcagcaatcttacagctgttaaggctggttcttttatttggaggacgtaatcgtgatgactgataccgtaaatacaagaagacttgcacttgatgttctgcttgaggtgacggaacatggggcatacagcaatcaggtgctccgtgccgtgctcgaaaaatatcagtatatggaaaaatatgagcgggcgtttctgacaagactggtggagggaacgatccagcacatgatcgaacttgattatgtgatcgaccagttctcaaaagtgaaagtgaaaaaaatgaaaccggtcatccgcaatattttaagaatgggtgtgtatcagatacagtatatggattccgtaccggattcggcagcctgcaatgaggcggtaaaactggcaagaaaaagcggtttttccacactgagcggttttgtgaacggagtgcttcgaaatattgcaagaaacagtggttccatccggtatccggatgaagaaaaggagccggttctggcgttaagtgtgcgttattccatgccggagtggattgtggaagaatggcttaacgcctatggcatggagcagacaaaggcaattttagatgctttttcaaaggaagcaccgattacgatccgtaccaatgtgaccaaaattacgccggatgcgttaaaggaacagttaaaagccgaaggcgtgacggtgcagacgttagaagaactttcttatgccggactgccatatacggatgcatatcactatgcatttgcaatttcaggttttgatcatctgatggcacttccatcatttcaggacggtcttttttatgtgcaggatatcagttccatgatggtggctgaggccgcagcaccggagaaaagcgcacatgtgatcgatgtctgtgcggctcccggaggcaagagcattcatcttgcggagatgctggacggcaccggaagtgtggagtcgcgtgacctgacagggtataagaccggactgatcgaggaaaatatcagccgttaccagataaaaaatatgacgacaaaagtgtgggatgccacggtgccggacgagagtgcagaagatacagcggacgtgctggtcgcagatctgccatgctccggtctgggggttttgcgcaaaaagacagacatccgctataaaatgagccgggggcagcaggaagagttagaagcacttcagcgtcggattctagatacggtctgttcttatgtcaaaaaggacgggatcatggtatattctacctgtacgatcaacccgggagaaaatcaggagaatgtcgcgtggtttttaggaaaacatcctgaatttgaactgcttgatatggaacagatttatccgggaacacaggtgggagatggatttttctacgccagattaagacgtatctcatagccacccggaaagaaaatggaaaagaggaaattatgcagcaggaaaaaacagatatcaaatccatgaatctggaagaactaaaatcatatatggaatctatcggagaaaaaccgtttcgtgccaaacagctgtatcagtggatgcatgaaaaacaggcagcatctttcgatgaaatgacaaatctgtcaaaatcccttcaggaaaaactgaaaaatgaatgctgctttgtaagtttaaagcaggaggcggtacagatctcaaagatagacggtaccagaaaatatctgtttgcattagatgacggaaacgtgatcgagagcgttctgatgcgatataaacatggcaattcagtctgcatttcctcgcaggtcggctgccggatgggctgccggttctgtgcatccacgttagacggactggtgcggggactgacgccgtcagagatgttagaccagatataccggatcacaagagataccggggagagggttgcaaatgttgttgtgatgggaaccggagaaccgatggataattttgacaatctgctcaaattcatcgaacttctgacagatgaaaacggactgaacatcagccagcggaatgtgacggtgtcgacctgcggtattgttccgaaaatgcgggaactggcggataaaaaactgcagatcacgctggcactttcgctgcatgcatcttcgcaggaaaagagacttgaactgatgccggttgccaataaatatgagatacatgaagtaattgaggcatgtcgttattattttgaacagacaggaaggcgtgtcacatttgaatatagtttagtcggtggtgtcaatgataccgatgaggatgtaagaaggcttgcagacctgatccatggcatgaattgtcatgtaaacctgatcccggtcaatccgatcaaagagcgttcatatgtgcagccggatcatgaagcaattcttaattttaaaaataggcttgaaaaaaatgcgattaacgttacaattagaagggaaatgggcagggatatagacggtgcatgcggacagctgcgcaaacgttatatcagccatgcagaaaggtaggaagtagagaagatgaagacgttttccatgacgcacatcgggcagcgacgggaaatgaatcaggattatatgtttacatcagagaccgctgtgggaaatctgccgaatctttttttagtagcggatggaatgggtggtcacgctgcaggtgattatgcttccagatttacagttgagaaacttgtggaactgattggtaaatcgggtgaaaaagaaccggtggcgattatgaagagtgctgtttccatgacgaacagtctgcttttgacagaggcacaggcagatccggccaaaaatggaatgggtacaacgatcgttgctgcaacggtgatcgggaatacactctatgccgcaaatgttggagacagcaggctgtatgtgatcaatcaggaagatattacacagattacaagggatcattctctggttgaggaaatggttcgtttaggtgaagtgagaaaagaagatgcgaaagatcatccggataaaaatatcattacacgggcagtcggtgtattgccggaggtgacagctgatttctttgagatcagtttaaaacctggggatgagattttgatgtgttccgacggactgacaaatatgattgaagatgatgagatccggcatattgtgttgggacagagggacattgttgagaaagcagagaaactgattgagactgccaatcgaaatggtggtaaggataatattacggttgtattgatagaaccattttctgatgaggtgaaagaatgttgacagaaggtatgtacatagcagaccgctatgaaattttaggtaaagttggcgctggcggaatgtcagatgtatataaagcaaaagatcttacactgggaagatttgtagcaatcaaggtattaaaggcagaattttccgaggatattaatttcgtaacgaaattccgttccgaggcacaggcagctgcagggttagagcacccgaatattgtaaatatttatgatgtcggcagtgagaatggcctgcattatatcgtgatggaatatgtggaaggaatcacattaaagacctacattgagaaaaaaggacagctttcttttaaggaggcagtcagcatcgcaattcaggtgggcagaggtattgaagccgcccataataaaaatatcgtgcatcgtgatatcaaaccgcagaatatcatgatctccactgagggaaaagtaaaagtaacagattttggtattgcgcgggcagcaacatcaaatacgatcagttcggatgtgatgggatccgtacattattcttctccggaacaggcgagaaatggatttgtggatggcaagagtgatatctattcactgggtatcgtgatgtatgagatggtaacaggccgtgttccgtttgacggggatacgacggtcgcagttgcaatccagcatctgcaggaagaaatagtaccgccaagtgtttatgcaccaaatcttccaatcagtatggaaaagatcatcttaaaatgtacacagaaaaaccctgacagaagatatgcttccatgacagcgcttctggccgatcttagaaaagcactgatcagcccgaacgaggattttgttgtgatggtacctcttgcaaatcaggataagacgagggtgatcggagcagatgatttaaatcagatcaagaaacagactgcaaacgtctatatagatccggcgtcgatcaaaatacaggagccggtggtcgatgatgatgacgaggacgacgatgatgatattgaggacgaggatggcgatatcaatccgaagatggaaaaggcaatcacgatcatgggaatcgcagcaggtgtagtgatcattatcatcattatttacctgtgcatcacgttagccgggggtatgaagtctaacaagaacaattcttcgaatacagaaacaacaaaaacggaaacacagacgggagacagtcagagtacccagatcaaggacggtgtagtagtaccttccctgacaggaaaaaccatggatcaggcaaaacaggagttaaacggaaccggactcggcatcagacaggctggaaccgcatcctctgataccgtagaaaagggacagatcataagccaggatccacaggatggaaagaccgtcgaaaagaatacaacgatcgaggttatcatcagcagcggatctgcgggcaacagtgagaatgcagtggatataccaaatgttgtcggacaaagtgagacagatgccagcgcggcattgacggcaaagggatttaatgtcacaaagacaacttcctacagtccctccgttgcggaaggatatgtaatttcccagacaccaaatggggataccaagggaaaagagggcgatacgatcacacttgagatcagccttggctcagagaagattacagtacctgatgtatcgacaagctataagtcagaggaacaggcgaaagaacttttatcacagtttaatgtttcaacggtcacaaaatacagtgatacggatgccggaatcgtaatcggacagtcacttgcgtcgggaacacaggcagatccgggagcatccatcacgatcacagtcagtcttggaccggaaccggcacagcagatcaccacaaagacttataagctgaatgtcagcctgcagcttccatcagatacatcgaatatctccggtgcagacattgttttatatgatgatcagggcaatgttttacagacctggtacggcaaaacgattgcagattttggtactggcggactgattctgacaaagaccggtattctttcggacagtggtaaaatcgtagttacctggctggacttaaatggaaatgatttaaaagaccagacgattgatgtacagttccaggaagaataaagacaataggaagatttatgcagggaaaaattatcaagggaatttccggattctactacattcatgtagcgggatccggaatttatgagtgcaaggcaaaaggcgtattccgaaaccagaacatcaagccactggtgggggacaatgtcgagattgctgtgttagatgaggaacataaaaaaggaaatattgaaaaggtcctgccgagggaaaatgagctgattcgtcctgcggttgcaaatatcgatcttgcgctgatcatttttgcggcggcaaaaccacagcctaattttaatctgttagaccgtttccttgttatgatggaatatcagaatgtaccggttgcaatctgttttaacaaaacagatctggttacggaggaggaactgcatgcgtttgcagacatctatgcggcgtgcggctaccggacactctatgtcagtgcaaaagaggaaaagggtgtggacgcgctgttagaacttttgaaaggaaaaacagcggcggtggcaggaccatcgggagttggcaaatcttctcttgtgaaccgcctgcagccgaacatcaccatgcagacaggggaagtcagccgcaagatcgagcgcggaagacataccacacgacattctgaaatcataccgatcggcggggatacttatattatggatacaccgggattctccacactttacattccgggaatggaaaaagaagacttaaaagggttttatccggaattccggaaatgggaaccatattgcagatttcagggatgtaatcatatcagtgagccggactgcggtgtaagacaggggttagaagaaggaagtatcagtttgctgcggtatgaaaactataaattgctgtatgaggaattaaaggctgtccgaaagtattaaaataaatgactaagattacggagaaaaaaatgaactgtttatcgccatctatattatcggctgatttcagccgtcttggagaacagataaaagagcttgatgaagccggggcacagtatgtccatattgatgttatggacggaatgtttgttccgagtatttcatttggaatgccggtcatccgtgctataagagcatgtacagaccgtatttttgatgttcatctgatgattgaggaaccgggacgctatattgatgagtttgccgaggctggtgcagatcttatcactgttcatgcagagagctgcagacatcttgaccgtactattgaaaaaatcaaagaaaaaggacttttagcaggtgttgccatcaatcctgcaacaccagttcctgcaatatcctgtgtccttgaaaaagtggatatggttcttgttatgacggtaaatccgggattcggaggacagaaactgattccctatacggtggagaaagtccgtgaattaagaaaaatcgtggatgagaagggattaaaaacggacattgaagtagatggcggcgtaaatctgtcaaacgtggaagaattgatggatgcaggagcaaatattattgttgctggcagtgcaattttttccggggatgtgaccgagaatacgattcgtttcttaaatattattaatgaatgatgggagccgatggatgaaacatttttttatcatagcgggtggaaaaattgaagatgcatttgcgatagaggttttaaaaggctttgctgaaaaaacagtgatcgctgcagattccggtatggaatttttgcggagaaatgaaattgttccacaggtcattatcggcgattttgattcggtaagcaaagagacactggaatggtttcagaaaaaagaagggatcgtctggcacagattgaatcctcaaaaggatgacacagatacagaatttgcgctgcgtcttgcaatttccatgggagcggagtgcatcactgtgcttggtggtaccggttcaaggttagatcatgtgctggggaatattgaacttctgggcatagggttagagctgggagttgaaattgaactgctggatgcaaataaccgtatccgtatgacagatcacggcatggtactaaaaaaagaggaacagtttggaaaatatgtttccctgattccgtataccgcgcaggtagagcatctgtatcttgcgggatttaaatatccgcttgccgattattgcttaaagggtttctgttcaattggtgtgagtaatgagataactgaagaacaggcagaaattacatttgaaaatggaatattgatcgtcattgaatcgcgggatgatgcggcaatggcggatgaatcatagaaaaagacggaatcagccaatttttatggcgggttccgtctttttgcaaaacagttattgttttcggcagccagtgtggtagtcagcggaggattggttcttctgctttacaggtatatcgggcttacagaatggtcgtgtgttgtcagaggcaatatcattcataccctctttaatctggctatataattcaaagcgactggttaattcttcgtaggcttcaatgctcataacggcaaggtcaccttttccataaatgatgaccaagaaatatgcttctgggtcatttcatttaccctatggcggggaggatttttcttgaatattagcactagccatgttaatatactatttgtcatatggtggcttcttttatttaataaagggagcaaataagaatatgggagttgatttaaaagagatttaggtctaaatctaagccaacgaaaaaaagatggtaaatatagagcacgttttataacggctagtagaaaaagagtagacaggatatttgataatgtaaaagaagccaaacaatggaatggatttaaagaaaacaacaagagacctaatacggttagaaatggaaactacccaaaactaaaaaaagaaatagaaccatttgcaacacgatttctggaaagtgcatcaggagagtatgcaaagagttataaaatgctatcccaaatgatgggacatagctcaataaaaatcacattagatttatatagtcacttgaccgaagagacagtgaaaaccgagatagataagttttccaattatatggatagaatggtttttgcataagttcatgaaaggtcataaatgaaatatataaaatgggggacaagatgggggacaaccacatgaaaagtccttgaaacactagaaaaataagaaagaaggaaaataaaatgaaacttggaatcgtcggactcccaaatgtcggaaagtctacattatttaattcacttacgaaggcaggcgcactttcggcgaattatccattcgctacgatcgatccgaatgtgggaattgtatccgtgccggatgagagaattgtaaagcttggtgaactctaccacacgaaaaaagttacaccagcaacgattgaatttgttgatattgcaggacttgtaaagggtgcaagtaagggggaaggattgggaaaccagtttcttgcaaacattcgtgaagtagatgcaatcgttcatgtcgtacgctgctttgaggatacaaatatcatccatgtggatggatccattgacccggcaagagatattgaaacgatcaatcttgaacttattttctcagatattgagatccttgacagaagaatctcaaaaattgcaaagcaggcaagaatggataagacgcttgcgaaagagcttgaacttgtagaggcagtaaagaagcatcttgaagatggcaagatggcaagaacgtttgaagtaccggacgatgatgatgcacagatctggtttaagggatacaaccttcttacagcaaaacctacgatctatgcggcaaacgtggcagaggatgatcttgcagatgacggagcatcgaatccgcacgttgcgaaagtcagagagatggcgaaagaagaaggcgcagaagtattcgtaatctgtgcgcagatagagcaggaacttgcagagcttgatgaggatgagaaaaaagaatatcttgaggatctcggtgttgagtcaagcggacttgacaagcttgtagctgcaagctattcacttcttggactgatatcattcctcactgccggggaagatgagtgccgtgcatggacgatcaaaaaaggcacaaaagctccacaggcagcaggaaagatccacacggattttgaacgtggatttatcaaggctgaggttgtaaactatcaggatctattagataatggaagtctttccgcagcgcgtgaaaaaggaatcgtcggaatggaaggaaaggattatgtggtcaaagacggagatgtaatcttattccgctttaatgtataaaaaatagtctaaaaatataccgggacgcatatggttttctaaatgaacggatttggaagactatatgcgtttttgtgaatttcagaaaaaagaagtgatcaatgtctgtgactgcaagtgtcttggaaatgtctgtgatctggagtttgatgagcatgacggatgtatccggacgattattgttcctggaccggcaaagttttttggatgtgtgggaagagaatttgaactgcatattccatggtgcaaaatcgtaaaaatcggaccggatatcatattggttgatatagaagaaaaagaagttcgtaagaaaatacagtaaaacgaaaatatttcgaaacttttcgttgaaataaccaaaaacaggtggacataacagggaaaattatgttgacaattacaaaaacaatggatatacttttaataaatggggtctgtgcataggaggtagcttatgaagtgtccgttttgcagcagtgagaatacgagagtcattgattcaagaccggcagacgataacaattcgattcgccgcagacggttatgcgatgaatgtgggaagcgcttcacaacatatgagaaggttgaaacgataccgcttatcgtgattaaaaaggacaataacagggagcagtatgaccgttccaaaattgaagcaggggtactgcgggcatgtcataagagaccaatttctgtcaatcagatcaatcagttagtcgatgaggttgagacggaaatatttaatcgtgaggagaaggagatcccgagcagtctgatcggagaacttgtgatggataagctgaaagatctcgaggcagttgcatatgtaaggtttgcttcggtatatcgtgagtttaaagatgtgaatacatttatgagcgaattgaaaaagatgttagacaagtaacggaacgctaaaattatgctaaagtatttacaaaggcagaccgatatagtttttgccaagaagaagatgcagatggatgggattgggtggtatgaatatttcaggtatccgtatacaggcggggttttatgattacaataccataaagaatactcagattcaggaggaaagtgtaccaaatgtcatagatacggcgggggaagatacccgtgtggctgaggttacagagagtgagagggataacaagccgggtcatggtgccacagagtatgcgaaacaatatcagccggatgcagagtatgatctgaaaggaatcgcgagcgatattacaagtctggatgtagagaaagctatctctgatatgaagaaggatcaggtgttacagcagtatcagttttttgttggagagcgtatgagccagaccggattattatatattcgtccgaatgaaaatttttcattgtaaacagaacattgatgatggaaaggggattgcctgtgggtgattctcttttttactggatatttttttgaaagtatagtacactgtactttgtatgaaaatttacatgaaaaaatatgtatgcagaccaaatttgcaggcaaataaaaatatacatacaaacccaaatttgtatgaaaatgaggataagaaaatatgatggaaaagttctatccggatgagtatctggattcaacctacgagatagattttgatgaattgtatgcacaggggtatcgcggtgtgatttttgatatagacaacacactggtgcggcatggagcaccggcggatgagcgtgcatgtgcactgtttgcacatttaaaagaactgggatttgcgtgtatgctgttgtcaaacaacaaggaaccgcgtgtgaaaatgtttaatgatgcagtcaatgtttcttatatctataaggcgggcaaaccgaatccagcaaattataaaaaggcgatggaggaactggggacagataccggcaataccatttttgtcggagatcagatttttacggatgtatatggtgcaaagcgtgccggtatccgctcgatcctggtaaaaccgattcatccgaaagaggagatacagatcgtgttaaaacggtatctggaaaagatcgtgctgtatttctacagaagagatctggaaaaaaataaagaaaaacaatagacagcatatttttgggcagcgcttttgttatggataaaatgctcatttaagagtaaataaaatagaaagaaatgaggaaaaaaatgaaaattgcgattggaaatgatcatgcagcaacagagttaaaatttgtcatcatggattatttgaaagaattaggtcatgaggtcattaattttggaacagataccttagacagctgcaattatccggagtacggtgaaaaagtcggacgtgctgttgtggcaggggaggcagactgcggagtgctgatctgcggaaccggagttggtatttcgattgctgcgaataaagtaaagggagtacgtgcggctgtatgttctgactgtgcaactgcaagacttgtcaaagagcataataatgcaaacattattgcattcggtgcaagaatcgtaggaacagagcttgcaaaagacatcgtaaaagcatatttagatgcagagttttcaggcggaagacaccagacgagaattgatctgatccatgagattgaggagcgaaatgaataaatccgcagtttttttgtcaatttgatggagcaaaacgaaaaaaagcttgaaatgtacaggcatttattataaaatagaaaaatcagagagtccaaaactcgggcgtatgtttaaggaggaagttacatgatttcagcaggagatttcagaaatggtattaccatcgagttagagggtaacatttaccagatcattgaattccagcacgttaaaccaggtaagggtgcagcgtttgttagaactaagttaaaaaatattaagagtggcggtgttgttgagaaaacattccgtcctacagagaaatgcccacaggcacgtattgacagaaaagattatcagtatctgtatgcagatggtgatttattctacttcatggatgttgagacatatgaccagatcgctttatccaaagacgatatcggtgatgccttaaagttcgtaaaagagaacgaaatggttaaaatgtgctcccacaacggaagcgtattcgcagtagagccacctctgttcgtagagttaagaattactgatacagagccaggattcaaaggcgatacagcaacaggtgctacaaaaccggcagttgttgagactggtgcaactgtatctgttccattattcgttgagcaggatgatgtgatcaagatcgatacaagaacaggtgagtacttatccagagtttaatgggtgcgagtgctgatttggcatagaagaccccggaagcgttttgtttccggggttttttcgtctagtacatcgtttcgtaaataactataccaatccgcaggcaagtgaatggtgtagttattttgaaaacgatgtactagtatagtaccctatcaggattaaggtggacaggagagagtcatgaagaaaattgcactgattatggatggctggaaaaggtggtttacttttgcatggccggcaggaattcttcagagaatcagacagaccggcgaggaagtgagtctgtacatctttaacagttcgggcggatggagctgcgatgaggagtataataccggtgagtataatatataccggcttccggatctgcgtgagtttgacggaatcattcttgatctcaataacattggctatccggaggtgtgggaagatgtgatacggcgggcaaaagagtccggtgtaccggtcatttccattgcaaatgagattgaagatttttattatgtcggaatcaacaatgaaaaagcaatgcggatgatgattgaacacctttatgagaaacacggatgtaaaaaatactggtttgtcatgggcccggaagataattatgagaatgtaaaaagaattgctgccttaagggcatatatggatgaaaagcagcttacatattcggagtctgatttttattgtgagagctttgaatatcagtgcggagtcaacggatttgaaaaattgcttgaaacacacgataaaggcaggctgccacaggcgattatctgtggaaatgataatattgcagttggcgtgtgcgaggcagccacggcgcacggataccaggtgccggaagatttttgtgtgacaggttttgataattttgacaaagcggcatattatgaaccgaggatttccacaatcagtcatatccgggaaaatgtcggaatcgcatgtgtagatctgtttcttcacatctggaaaggggaaaaaccggaccggttttattatacggatacagaaggcattttctgggacagctgtggctgtatgccgggagaagtgccggatcaggcagaatatttaaaagggcaggtcatgtatggaattgagacagcacggtttgaggatgaagtattttccctggaatacgagcttctcaaatgcaatacagtccgtgagatgatgtattgtattccacaatgtatcccgtctttaaagtgtgatgcgatgtatttgatactggattcacatatggatacgtataaggaacaggtgaaaacacatcggagcctcagcttttttgaggaggaagattttcatgtggagggctatccgaaatgcatgcaggtaaagtttgcatataaaaatggtaaaatgctggatacagaccagatggagatcgaaggtatttttccattttttgaaccacaaaagggcggaacggattttctgtttctgccaatgcatttcagaaaccgtacagtcgggtattttgttattgaaaatgcagtttatctgatggaaaaacaatatctgttccaggtgataaaaacactgaccaatgcgatggaaaatctccataaaaaagaaaaattagagcatatgaaccagatcctttccgatctttatgtcagggattctgtgacgggactttataaccgcatgggataccagaagttgtcgataagttacttcacgattatgcgcgagaaaaaaatgcctgtgttagtgatgtttatcgatttagaccggttgaaatacattaacgatacttttggacatgagtatggggattttgcaatcgtttccattgcaaaagcgatgttgaaacattgtgatgcagatgcaatcgcagcgcggacaggcggcgatgagtttattgtattagagggcgcaaaggacgaggaatccggcagggtattagcacagaagatccggacggaattgagtaagacacagagagcaatgcagctcccttttgatttgagcgcaagtatcggtgctgtagtcgcacatcccggggaagaaaacgtgttagagagttatgtaaaacgggctgagatgctgatgtatgaggaaaaagcggagaaaaaagtaagcagggacagttgacagatgagaaaatttttgcgtggcagactgcagggatatggcagggcataccggttgaatctgaaagataccggatggggaatgaaattggtggtgcttgtgatcacgggatttttctgcggtgcactggcatctgaatattttggaacgaaactgatttttttcgttggaggagtgatcttaggcgatatgctgttcgcgggggcagcatgtctgttttcacgcatcggcggccgcatctggcatcgcaatattgagagttttttgtatgggattgcaggatttttgatatttgtctgctgctgtgtatatggaagtgttggcaatgaacatatggtcagcactttttttgctgcattgatttattttttgctgctgttatcgggaagatttatctgggcgtggcttgtgaaacgacggcatacactgtttagcggaatccactttgcagcgggctgcatcgtctggtgcgcatttttggcatttttgtttggacagggattttcggacagatatatttcggattatctcaaaaaaaatatctatgtgacacaggcaggtgaggtggcaggatttgcagattactgtgcaaaaggagcatatacgcccgtctgtttgacctatggtccggatggtggaaccgatatgacgacggggacagtggatttaagtccatatgtggcaaaagagaaaaagtggcacagaatctatcgcagtttctttacgaaacataccagaaaagatgcaccaatcgcgggaaaaatctggtttcctaaggaggcagaaaactgtccggtcgtgtttatggcgcacggcaaccacagcattacggcagagtcatatcgtggatatgattatctcggagagtatctggcatcacacggctatgtgttcgtctctgtggatgaaaatattttaaatgagagaagtggggaaaatgatgcgcgcgctgttcttcttttggaaaatatcggggagatcttagagaaaaacggggatgaatcgcagccggtctacagtaagatcgatgaggacaatattgcactgatgggacattcgcggggcggtgagatgatcgcggatgcatatctttttaatgagtatgatgcatatccgagcaatggaatgtttatgtttgattatcattacagaatccgggcacttatcgcagttgcaccgtctgtcagccagtatctgccggcggggcatgaaacggaattgtcagatgtcgattatctggtgctgcagggggcaaacgatcaggacatcagtgtttttctcggaaatgagcagtatgagaatgtttcattttcaaaagacagatcgtatatagcatcctcgctctatattgccggtgcaaatcacgggcaattcaatacggaatggggagaatatgatatcgggaggccgttttccctgtggctgaatgtaaaaaattttattacagcggaggatcagcaggagatcttaaaaattgcctcgcttgtttttttagataagagcttaaaggaaaaagacacctatgcggattttctgacagattatgcaaagtatgcggaatatctgccggaaacactctatgtgcagcagtatgaaacgtcagacgctttgtttatcactgattatgaggaggactctgatttagaaacggcaccatgtggcagcgtatcagcggagcattttacaatgtggacggaggaagaattggcggattctgaatcggcgatgggaaagagggagaaccatgcagtgcgcctgaaatggaaggacactaaagcggcatattatgagatcgcactggatgagccgatggcaatgggagagggcggaatctgttttgatgccatggatttgagggagaaagcggagaatgaaccgatggatttttctgtggtgctgacagatatccatggaaatcgtgcggtcagtactttatgcgattctacgatcctgtatccggcatttccggtaaaattatccaagatccagtatatcacaggaaaaaatgaatataagaggcagcttcagaccgtgcatatcacggaaaagcagtttacggaggaaaacggatttgacaggagtcagatcagaagtgtacggtttgcgtttgacaggatagaaaacggtgcggtgaacatggataatatcgcttttgtaaaatagaaaaaagaaaattttccgggaaggtgcatataatagtggaaagaatgatacaaaggggaaaatatgcaatttttaatacagggagaccgtggtatctgggtagaatatttgcagcttgcattgaccagagcgggatatccgacgagaattgacggaattttcggggagcacacctgtcaggcgctgaaagattttaccggaaatacggatgtgtgtacggtaaaccgtgcggtatgggagcagttaaaaccatatctgaccggataccgcatgcatacgatcgaaaagggagatacggtctttggactgtcgcgcagatatgggacaacggaggaggcaatccttgtggcaaatccgctgatcgatccggatgatctggttgttgatgccgttttgacgatcccgcttggatttccgttagttccgcagatggtaaaatatacgtcagtcctgacacagtggatcgtagagggacttgtggtgcgctatccgtttctgtccaccggtgtcatcggaaaaagtgtgatgggaaaggatattcacagcctttggattggaaccggtgagaaacaggtattttacagcgcttcctatcatgcaaatgagagtattacaacgccggtgctcttaacgtttgcagaggagtacgcggcggcttatgcggcgggcggaaacattgctttttcatcggccgcccgggaggaaaatgacggacagacgggcatggggcaggaatcggtggatgcgcggaccttgtttgatgaattcaggctctgcatggtgccgcttgtgaatccggacggggtggatttagtcaatggtctgttaaacagtggtgtatattaccgcagggcaaaacggatcgcagatgattatccgtcgatcccgtttccggatggctggaaggcaaatattgacggggtagatttaaatctgcagtttccggcgggctgggagatggcaaaacagatcaagttttctcagggctatgacaaacctgcaccacgggactacgtcggaaaagcaccgctcacggcaccggagagtgttgcagtctatgaactgacaaaagagaatgattttttactgatccttgcataccacacgcagggtgaagtcatttactggaaatatcttgattatgaaccggcaaggtcaaaagagatcgcagattatttcggcagtgtgagtggctatgcggtggaagaaacaccgggtgcctccggctatgccggatacaaagactggtttatcgaggaatatgacagaccgggctatacagtcgaggcgggcatgggagaaaatccactgccgatgacacagtttgagagaatttatcatgacaataagggaattttggttggcggcatgacgcagctgcgttaaaatcaaaagaaaaagggcggcagaataagaaagaatcctggtttacaggattctctgcctgctttatagaaaatttttcacggctgggactaatgtaaaaactatagcttatgagatagttcgtggcagattatttgaaaaggagaatgtgaaaaatgataaaaatagatctgatcaccggatttttaggttccgggaaaacaacgtttttaaggaagtatgcctcttatctgatcacgcaggggcagaatatcggaatactggaaaatgattttggagccgtcaatgtggacatgatgctgcttggcgatctaaggggggacaactgtgaacttgagatgatatcgggcggatgtgatgctgatacgcaccggagacgttttaaaaccaagctgatctcgatgggaatgtgcggttatgaccgcgtgatcgtggagccatccgggatctatgatgtggacgagttctttgacacgctccatgaggagccgctagacggctggtatcagatcggaaatgtcatcaccgtcttagattcgaatctggaagaaaacctgccggaaggtgcagattttctgcttgcgtcgcaggcagcgaatgcagggtgtattattcttagtaagacacaggagacaacagaatcggatcagaaaaatgcggttgaccatttaaaccgtgcactggaaaaaatcgggtgtaagagacagtttgataaagttttcgcaaaagactgggataagctgacggatgaggactttaaaaagctgttatcctgtggctatcgcacggaaaactacctcaagccggatctgacacaggagaaaacatttcagtctctctattttatgaatatgcacctgacggaggtcaaattacaggaagccgcacaaaaattgttctcggacaagtcctgtggaaatgtattccgcgtcaagggatttatgaagaatgaaaaagagcagtggatcgaactcaatgcgacccaaaagaatctggtgatctcaccaatcaaaatggggcaggaggtcatcatcgtgatcggggaacagctggtggaggatgcaatccgcagctgtctggaagtataggatcttaattgcattgaacagtacagaaatgaggagtaccatgcagacatattatcagttttactggaacaaaatcgatgaggaaagtataaggattttgaggatatttggagagtcagaggacgtcatcgtgccggagacgataggcggacgtgcagtcatggaggcgggggattactgctttgcggcgtcgaaacacctgccgtcagaatacgagtgcacggtctgtatttatgacacggagggaaaaaagtggcaggagataccggcagatgatgcagactggaacacacgcctcgtggaacttagcggtgacaggttaaaaaaggtgacactgccagataatatgcacaaagtgggaaactatgcattttacaactgcaccgcattagaaatgcttgtgaccggaaagtatctggaagagatcggaagcgatgcttttatgaactgtaaaaagtttcattttctgacggtacgctgtgatgtgggggagcgcagcggggcaaatcagatcttaagccggatttctgcagatatggaagtgacatttcaaggaaaaactgggcagacagccgtcttttatcctgaatattatgagaactatgatgagatcgctccggcacatatttttgggcggagtatcgagggagaaggcttccgggcaaggcagtgttttaaggagggagtcccggatttaagccagtatgatacgatttttccgaaagcatgtgcggaggaaaaagaaaatacgctgcttcacattttaagcctgcggctgcgttatccggtcagtctcacggatgaggcgaaggagcggtatgtggcacatttaagggagcaggaattatatatcatacccaaacttgtaggacaaaaaaacatggaacggatcacatttttctgtgaaaatggctggatcacacaggcggcagtcaaagccggattagaacaggcttcccggatggagtgggcagagggaacggcagaacttttgcatctgcagagaaaatactttacagaacagaaaaaagaacgatattcatttgatgaactgtggtaaaagaatgttaatctactgtaatttaaaggagaaacccaaatggcgcatatacagacagagtcagagtggcaggaagagatgtcggcaaagatcgtggaatttgtacggcatgaattatacatggaactgcggtatttaaaactggcattatcgcagttacagttaaagtccgatccagatctgcgggcatttgcgacggacggtgcgtatctttatgtggcaccggaatggctgatcgggatttttgagaaaaatgcacagtatttaggccgtgcatatctgcacacggtattacactgcattttttcccatctgtggatcggcggaaacagggacagaaaaacgtggcatttagcgtgtgatattgcggtggaatacacgatcgaccagatgcaggcggagtgtacaaaacgtattttaagctggacgagaaaacagatgtatgacaggctgaaagagcagaaacagcagaaacaggggatttccgcggcagtgatataccggatgatcgagaatgaagagctggaacaaaagattctgctccaaaaggaattttacacggatgaccattgttattggccgaaaaaagaggacggacaggcaaagcaggaacaggcggtaagaaaccagaaccagtggaacaagatcgcaaggcagacgaagatggaacaggagatgcgcggcggcgagacgacggacggcgaagatttatttctggcgcaggcggcagcggaaaagagcagaagaagttataaggattttttgcagcgtttttccgtgctgcgcgaggaaatcggagtggatccggaggagtttgacttaaactactatacctatggattgaaattatatggaaatatgccgctgatggagccgcttgagagtcgtgaggtaaaaaagatccgcgagtttgtaatcgcgatcgacaccagttactcgacgagtggtactctggtggaacagtttttaaaggagacgttttctattctgacgcagaaaaacagcttttttgcgcagtcaaagatccgtgtgatccagtgtgataatcagatccggtcggatgtggaattaagaagcgagcgggatattgcggcactgatgcagaaatttacggttgcgggcggtggaagcacggattttcgtccggtattttcgtatgtcaatgacctgatcgagcgcggagagttaaaaaatattggtgggcttttgtattttacggatggcagggggacttatccgaaaatgagaccggactatcagacggcatttttgtttttagaggactatgataatgcggcggttccgccatgggcaatccggcttaagttagagccggaggaatttgcagggatgccataagggggacatgaatcagaaagttgaatgaaggagaagggaaaatgaaatcaaaaatagatttgagcggaatgtgggaattttgccttgacggggacaaaaaaggcatggaacaggaattttataacagacatttttcggacacgatcgcattgccgggaacgacctcggaggcaaaaaagggcgggcggagagagaaaagagagataggatatctgaccgaaccttatcattttgaggggtatgcgtggtatggcagagaggtggaagtaaaagattatcagccgggggatcaggtcattttaaaattagagcgcacaagaaaatcttatgtgtggatcgatggcgtgtttgtgggaagccgtgagagtttctgcacaagccatatctatgatctgactgcatatttaatgcagggcaggggacacctttctgtcatgatcagcaatgtggattataaggcgccgggcggtcatatgacatccccggatactcagacgaactggaacggcatcttaggtgaaatttcacttcgggtgtatcgcggtgtgcggcttaaagatgtttttgcagagtcgtgttggaagaaacggcagcttaagatcgctgtaaatgcagcggtggatgataaaatatcgcagttttatgcaaagcttgcggtcagtctttgcaaaaaaggggaatccgtggactggttttgtgagagcgtgccggtacagcttactgcgggagcaaatgagatcacacatacatttgatctaaaaggacagaatgaaccggaaggctggaatgagtacacgccggttctctatgaaatgagggtggaaatttccggagagacgtccggcggcacttatgcggatgaaaaaaagatctgcattggttttcgggatctcacaacggatgagcggagtttttatctgaatggacagcctctgctgctgcgtggaaaacacgacggaatgatctttccgctgactggctatgccccaatggatgtgcagtcctgggaaaaggtgtttctgaccgcaaaggattacgggatcaaccactaccggttccacacctgctgtccgccggaagctgcatttgtggcagcggatgaggtcggaatgtatttagagccggaacttccgttttggggaacgatcgcggcggaaggggagccggagtatgataagacgagacaggaatttttaaaacaggaaggctatgatatcttaagggaatacggaaaccatccgtcatttctcctgttttcactgggaaatgagctgtggggaaatccgaaagtgttagatgagatcctcggtgattataaagcggtggaccgtcgtcactggtatgtgcagggatcaaataattttcagtttgtgccgactgtgcttgttaatgatgattttttctgtggggtacgtttttcaaaagagcggctgttccgtggatcctatgccatgtgtgatgccccgcagggccatgtgcaggttaaaagaccggaaatggaatacagttatgatgataaaatccgtccggcacagaaagcagagatggagagtggtgtcggggagatcgagatccagtttggaacagggacaaagaaggtaaaggcagaaggaaaggaagagttgatccctcacatcccggtcgtatcccacgagatcgggcagtacgagacatacccggattaccgggaaatcgaaaaatataccggagtgcttgtgccggagaatttaaagatatttaaggaacggctggagcaggccggcatggtacatatggcgcagaagttttttcaggcgtccgggaaacttgctgtgcagtgttataaacgtgagttagagacggcatttaagagcagagaacttgcaggttttcagatcttagatctccaggattttaccggacaggggacggcattggtcggtatcttaaatgcttttatggaaaataagggattgatcacggcggacgattggagaagtttttgttcggattgtgtgctgatgctttcttttccatccttcgtgtatgaagaaggaatgaaattttcctaccgcatcctgttttcaaacatgaatccgacagaacttaaagatgccagaatcgttgtgaccatgcaaaataaagtgaccggggagcgcatgagaaatgagacagagcggatgcattttacacagacgcgtctgagtgaatacgctgacggaacatttcggattccggagtgtggtgtgccgcaggtttatgaggtccatgtggagatagagggaagcagtatagagaacagttatgagatctatgcctttccgaaatgccattctaaactgggggatgttgtgaacatactgcgtcagaaggcggatacgctgccggtcatcaccgatcggtatgaagagttaaagcgtgcggtggcagaaggcaggaaagtgttattttttggcaccggtatccgggatgcctatgcaatgatcggaacctactgtacggatttctggtgctacccgatgtttgcatcgatctccgagagcatgaacagaccaaaaccggttggaacgatgggactttacatccgctcagagcatccggcgctggcggagtttgtgacggaggaatatgagacaccgcagtggtgggatatcgtaacagaggaaaaaaatgcaattttagacgggacagacattgaaccgatcgtctgggtaatcgacaattttgcccgcaatcacaggcttggactgatctatgaggcgaaagtggataatggaagcgtactgttttgtcagccggatcttttgcataaagatgagatcgcggcaaaatggctgttctacagtttgtatcagtatgccgcgtcagagcgttttgtgccggaacagactatggaacccggacagatcgaaaaaatgtatggataaaaacagaaaattttgaagaaatgcacattttgtgatcttatatttgggagatacttatgtattttaaaagaaaagtatataacgaattattagaatggaaaaagacttattcagataaatacgctgttttgcttgaaggtgccagacgggttggaaaatcgacgatcgcggaaaattttgcccaaaatgaatataaatcatatatttaatagatttttcaaaaacagcgaataatatacgggaatgttttgatgatataggaaatttgaatatgtttttttgagacttcaggcggaaaccggagtgacattatatgaacatgagtcattgatcatttttgatgaagtacaactttttcctaaagcaaggcaggcaataaagcatcttgttttggatgggaaatatagttatctcgaaaccggctctttgatttcaataaagaaaaatgtaaatgaaaagacttatagttgcaagcaaaaagcatgcggttctatataaatttagaagcggcatgctttttttgggattcatgtcaaaaaacgcaaattcacaaaaatacatgcgaataaagtctgaaaattaccgtatatccggaaaatgacaactgctataatgaaatctgcgtcgacaaatgaaaaaagtacatgtggtaaacaaaaatttttttacctaaagttatcagacaacacgcaatatgacgcggaaataagagaaaaaatataaaatagtacttatttaccacacaacggtttctgtggatattgaacgaaaagcggcacgaaaataacttaaaaaataaaaaattaagtaaatgtgaacaaagtgtgaaaatccaataaaatatcttctacaaaaagcagaaaagaaaaatgtgcatattacacaaaaataatcacaaatattgacatataataatgcaatatatataattaaaattaagttaacgataacttaaaagttaataggactaataaaattagctggaagggtttgaggggaagaaatattgttataaattaagagggggatagccgtgagaatgggatttttgaaacaggggttttcgggtgcactggcggcagtgatggttttgacatccggagggctttgcgtggggcagagtgtgacgattcacgcagagacaaaggcaaagacgtatgaggattataaaaaagtgctcaattatacggcagaatatcaggggtatgaagcctataaagagggacttgaaaatgtaaaaagaccggagacgtcttatgagatcaacggagccgattatgtgacatgtgagggcatggagccggaagttcttaccgattatgaggggatggaaggaacctctgtctacacggaagagagtgggatgcttacctatgaggtggacattgcggaggaaggcatgtatgagtttggtatttcctactatccggtagcgggaaacggttcctccattcagagaagtttttttgtggacggcgaactttcgtaccgggaactttcactgatcgaattttcaagagtgtgggtaaacacctccgatatctgggatgaagacaatcagggaaatgatttaaagcctacgcagatggaggcaccggaatggctcttttccaggttttacgatcaggacggttatgtgacggaaccgctctccattttcctcacaaagggaaaacatgagatcaccgtcgtttcccgcagagagccgatgatccttcattccatttatttacagaatgaggaatcgctttttgattacaagaccgtgtacgaacagcagaaaaaggacggggtatcagataccagcggacagtccattgagatccaggcagaatatgcgacgaaaaagtcgtcgagaatgctttatccggtacaggatcagtcctcaccggcgatcacgccgtacagtgcgaaagagttaaaaaataactccatcggcggcaatagctggagactgacgggacagtggatcgaatgggaatttgacgcggatgcggatggcttttacaatatcaccttacattcgaaacagaacttcgtcaaaggaatctatgtttcccgcaagatcatgattgacggggaagtaccgtttgaggaattaaaccattacggttttacttatgacagtacctggaaaatgacaacactctccgatgcatcaggggaaccataccggttttatctgaacaaaggccaccacaccttgcgtatgcaggtggtgctcggcgattttgccggagtcatcagcgatgtgcagagcattgtgacagagttaaacagcgagtaccgcaagatcatccggatcaccggcgtgtcaccggatgagtaccgcgattaccagatcgagaaacgtcttccggaactcgagggcgaactgaaagtgattcgggatgaactcgatgaggtgttaaacaccttagatacactgggcgttgccggaagtgaggagaccgtcattatcaccatgcgggatcagcttaatgaaatcctgcgggatacggaaaagatcacgaagatggtgaaggcatttaaaacgaatgtcagcgcacttggaacgtggatcacgaacgcacagcagcagccattacagttagacgccatctatatcacttctccggatcagaaggtaacggaagaaaacggatccgtggcagcaggcgtcgtacatgagtttaagaaattattctattcctttatcgtagattacaatgcgatcggaaatgttgcggaggaaggcgaggacagcaggacgatcactgtatggatcggaagcggacgtgaccaggcgaacgtcatcaaagcactgatcgatgagacttttacaccggagacgaatatcaatgtcaatgtacagcttgtggatatgaatacattactgcaggcgacgttagccggacagggaccggatgtggcactgcaggtggcaaacggaacaaacggaacggtagcaacctcatccaccggaacgacggcatcttcgaatgatcttccggtcaactacggactcagaagtgcagttgtggatctgacacagtttccagattatgaggatgtagtgaaacgtttccgcgagagcgcggtggaaccgtttatgtatgacggtgcactgtatgcgctgccggagacacagtcgtttgagatgatgttttaccggaaagatattttaaacgaacttggaattgagataccaaagacctgggatgatatgaaagtcgtgttatccgagctttccaaaaatcagatgtcgcttggcatgttgccgacggagctgactttcaccagtcttttatatcagcacgacggcgagctttacaatgaagatgcgacagcatccgcgttagattcggatgaggcggtcaatgcatttaagacttactgtgagttctacacagattacaaattagaccgtgagacctccgtggaacagcgtttccgtaccggagaatcaccgatcatcattgcagactatacgacttacaatgtacttgaagtatcagcaccggatatcaagggcttatggggatttacggcactgccgggcgtgaaagaggaggatggaagcatcaataatatctccgcaagcacaggacttgcatgtatgatgatgagcggcacgaaagataaggaagcatcctgggagttcatgaagtggtggctttctgcagagatccagacttcctatggagaagagatggaaggtctgatgggtgaggcagcacgttatccgacagcaaatattgaggcatttgcgaacctgccgtggccgaccgatgactacgaggcgttggaggcacagtttgcaaacgtaaagggaatccgtcaggtaccgggaagttactttacctggagaaacgtgaacaatgcgttctatacggttgcagtcgcagatgaagataagagaatgcagccaagagaagccctttatgaatatctcgaatatatcaatgccgagatcacaagtaaacgcgaggagtttggtatgaaaaccgcgtccgatgcgaagcagtaaacgcaggctggacaaagggaatggagattgggatgggagaaacaaagaaaatgcaaaaaaggagtaagtggcagcagacaaaactggaaatgaaaaaatacaggatgtcctatgtgatgatcgcaccgtattttatactgttctttttattcacggttttgcctgtgcttgcctcgatcgggatcagttttaccgatttcaacatgttagagacaccgaattttgtcggttggagaaattacatcaaattgcttttggatgatgatgtatttaaaaaagcattcaaaaacacgatcatctttgcagtgatcacaggcccgttaagttacatcatgtgtttcctgtttgcgtggatcatcaatgagtttaagggaaaattaagggcgtttttgacactgatcttttatgcaccgtcgatttccggtaacgcctttatggtatgggcaatcatcatttccggtgaccgttacggatacttaaacggctggctgatgaagtggtcattcctttacgagccgattcagtggatgaaaacagaaaaatatgtgctgccgatccttattatcgtacagctctggctgagtcttggaaccggatttttgacctttatcgcaggtctgcagacggtcgacaagagtctttacgaggctggtgcgatggatggcatcaaaaaccgctggcaggaattgtggtacatcacgattccgtccatgcgtccacagctcatgtttggagccgtcatgcagatcacacagtcgtttgcggtggcagatatctccatcaaccttgcgggaaatccgagtgtgaattactccggtgcgaccatcgtcacacatctgatcgattacggcagcggtacccgctatgagatgggttacgcctgcgcaatcgcaaccgttttattcgcgctgatggttggaacaaaccagatcgtacaaaaagcaatcagaagggtgggtgaatagtttgaaaagaaaaaaagattactataaaaaaccatcccgctggaaaatcagacatacgaaacagttaaaccgttccatggcggggaacacgatcctgtttgtgatcatggggatctgtggtgtgtttatggcactgccgcttgtgatgatcttaaacaatgcgttaaaaccgctggacgaattgttccgctatccgccacagatctttgtgcggaacccgtcactggataatttcagcgacctgtatgtactgatgtcaagttcctgggtgccgtttacccggtatgtgttaaacacactgatcattacagggctcggaaccgtagggcatgtgctgtttgcatccttagcagcctatccgcttgcaaaacatgattttccgggaaagaaatttttattctcgatggtcgtattatcattgatgttttcctacaatgtcactgccatcccgaactatatgatcatttcctggctggggatcaacaatacatatttagcagtcattttaccggcatttgcatatggacttgggctttacctgatgaagcagttcatggagcagatcccggattcgctgatcgaatcggcaagacttgacggagccggggagtttcggatcttcttttccattatcatgccaaacgtaaaacctgcatggctgacattggcgatcttccagtttcagacattatgggcaaacaccggaagcggatttttgcggagtgagcagttgaaacctctccagtacgcactgtatcagatcgtcgcaggaggcccggcaagacagggtgcaggagcggtggtacagcttatcattgcagcgataccgatcacgttctttatcatctgtcagagtaacgtcatcgagacgatgaccacatccggtatgaaggactaatggggggagaagaaaatgccagaaaaaggaatgcgaaagtgtatattcgccgcggcggcagcagttgcagtacttctttccgatatcggaggaacggctgtctatgccggggagaatgtgccttatgaaacgtacaactatgattattatgaagacatcaaatacacaccggcggcgtatgtgccggacggtaccgtaacgggggatgtcattggatgtggaaatttttccagtccgcaggacttaaataccgatgcagatggaaatgtctatatcgcagataccggaaacaaccggatcgttgtgacagactctgattttcagttaaagacggtgattgaggggtttttaaatgacggaaaggaagacaacttttcctctccaaatggagtttatatttcggaaaacggatatctgtatgttgcggacaccggtaattaccgcgtggtcgagttagacaaaaatggaaatctgatccagatcatcgagaatccgcagtcggatatccttggagaaaattatgtgttttctccgcttaaagtagctgttgactatgcagacaggatctatgtcattgcacagaaccagtttgaagggattatggcgtttgatgcagaaggaaacttcaccggttttaccggaacgatcaatgtacagatcacaacagcggagatcatctggagaaaactttccacgaaagcacagcgtgcaaaacagcagcttttcattccgacggaatttaccggaatggagatcgactccgacggtttcgtctatgcgacgaacgtggatgcggagggagaacagtccgtgcgccgcttaaatccaagcggggaggatgtgatccagaaaggtgctgccggggtatccggtgatattttatggcggcttaccggtgattattcgggagcatcccgcatcatcgatgtagtggtcagggagaaaggaatctattcggtcatcgactccacgcggggaaggatctttacctacgatcatgaagggaatcttctctatatctttggtggtatcggaagtcaggagggtacctttgatacgccgaccgcgatcgatacgatcggggatgagatcattgtactggacggttccaaaaatcttgtggataaatacagggcaaccaattacggtttcctgatcaaccaggcagtcggtctccgctacgacggggatgaggcaagcgccgtagagtgctggaaacaagttttaaaattagattccaattttgaactcgcctatgtcggaatcggaaaaagttatctcgccgcaggagaaaataaaaaggcgatggagtgctttaagaccggaaataacagacagtattattccattgcatacaagcgttaccggaatgagatcttaaaggaaaacttaaccggatatctgactgcggcactggttcttatcattctgctggtgctctggaataagatcggcaaaaagaaatggaaagagaggagggcgtctcatgtttaagaaaaaagtaaagtatgcattttatacactggggcatccgtccgacggtttctatgagatcaggcaccgcggcaggggaagcgtgggactctcgatcctgttcgtctttttgtttgcagtctgcttttctgcaaacaggcagtatgcgggctttgtggtcaacaatgtaaatccgatggagatcaacagtctcgcggagatctgtgcggtatttcttctgttctttctgttttgtgtcggaaactggtcgatcacctgcctgatggacggtgagggaagatttaaggatatcgttacggtgtgcggttacgcaatgcttccaatgatacttacatttattccggcgatcctgttttcacaggtggtggcagaagatgaagaagcgttttattatctgctcttagcagtcggaattgcatggtttttgttcctggtgctggttggtatcatgacggtacacaattatacattgggaaaaacgcttgcaacgatgatactgacttttatcgcaatgctggtcattatttttgtggtgatgcttttgttttcactgatcggtcaggtgatctcgtttatagagagcttatataatgagatcatgctgcgggtataggaaatgggggcagaaatggggtttactatgaaacgaaaaataaaatggaaagtggttgtggccgccggggcagcggtcatcgccgtgggagtgatcgcaaatgtcgtattccgttatttcagatatgatgcgtacaaacagtatctttcttcctatgaagtggagagtggaagcgaatttcaggcggcaaaggatgacaaaccgtcagttcccggcatggtcttggttgcggaaaacgatacattaaaactttataccaatacagaaacgacagagatcgcagtctacgaaaaagaatccggaaatatcacctattccaatccggtggagcgcgattccgatgcgattgccgctggtgtgaatgcggcagaactgaatgcgacactgacacttacctattacaatgcggcgagaaacagtgcgacgatgaacaattatgatatgagcatcgaaaaaggacagtttaccgcagagagtattgaaaatggcatccgttatacctatacacttgcagatcttgattcggcaacaggtatcgtaccgttgcagatcacagaggagcggcttcagacactggtgttagataagttagacaaaaaggatgcaagaacggtaaaagcaaagtttcgtctgaaagacggcgtctataagctgaatgaaaaggcacagtcctcgaaagtcggaatgggaaaattaaataaactgttcgagcaggctggatacaccgcagatgactatgccgtggatatgtcagagacggatgagaaggagaatatttcctttacaatcccgattgagtaccggctgacagaaaacgggctgagcgtttctgttccgacaaaggaaatcgaggagaagggtggagccgtgatctcaaggatccgtgtccttccattcttcggggcggcggggacggatgcagatggctatatgttcgtgccggacggatcgggagcactgatcaatttaaacaacggttgtaaaaacgcagcgtacagccagaatatctacgggatcgacccggtcgtacagagctatgttgtgacagagtatacagaggatgcaaggattccggtatttggaatgaaaaatggcgatagtgcatttcttggcaggatcacaggcggcgatgcactcgcaatcgtaaatgcggatgtgtccggaaaacttaacagttataattacgtttacccggagttctgtgtcagggagatcgaactattgaatatgttcggtgtcagcggaaatcaggcggatgtgccggtacttgaaaatgatatttacgatgaaaatcttacggtatgttattctttcctttctggggatgaggcagattattccggcatggcaaaatgttaccgtagccagctcatcaaagagggtgtgttaaaggagacaaacgacactggagatatcccgttgtatttagatgttcttggcggtgtggagacgaaaaaacatgtgatgggtgttccttacacaggaatctctgcgatgaccacttacgaggaagcggaaaagatcttagaggagttttacggcgaggatatcacaaagatccgtatgaattacgaaggctggttcaacggcggcatctatcatgatgtggcagataagatcaaactggttaagaaagtcggaagtaaaaaagattttgaacatttaagtgatgtcttagaggaaaatggtggagctttatatggaaatgtttccttccagaaagtaccgtatacttccaaacgttttaacgatgtgcttgaggcgtcaaagtattattccggttatgtggttgagcttggtgccgtcaatcctgcgacgatgcggcagacaagtaccttaaactggtatgacgagctcgcatattatatgatctcaccgaagtttttaagccgctatgtagacaaatttacggataagatcacaaattacgagattagcggtatctgtctgagggatctttcgaatgttttagtctctgataaaaagagaaccgagctgatcgacagacaggcagcaaaacagatcgtggaagcgcagtatggaaaacttgcagcgacggaaaagacgctgatggaggagggcggcaacgcttacaccttcggttatgtctccgacatcatcgacgcaccggtggagtacagtcagttttacatcattgatgagcaggtgccgttttatcagatggtcattcacggaagtattgattattccggggaggcattaaatctcagggatgctgacattgatgacgcactgcttcttacttacatcgagtatggctgtgcaccgagatttacattttcctgggaagattcaagcgtcatgaaatatacttcctcggcggaccagtattccacctgttaccagacctggatgagtgatgccgtaaatgtttaccagacgatcaacggagctttaaatcaggtgcagggtgctgcgatgatccatcacgaagtgacagagggcggccttgtcaggaccgagtatgacaatggtgtcagcatttatatcaataagacagataagagtatcacagaggacggtgtgactgtagatgcaatgagttatcaggtaaagggaggtaaggcataatgaagaaaaagaaaaagttatctttactgcagaaacgtgccctgacaggttttgcatttatcacaccatggctgatcggatttttatggttctatgtaaaaagcctgatccaggcagtgcggtttagtttaagcaagatggagatgcttgaatccggaggatatacattgaagtttaccggtcttgataatttcaaatatgcactgtttcaggatccgacttacaaccagattctggcgacttccatccgggatatcgttattgatgttccgctgattatttttttcagtttgtttatcgcgatgatctgtaatggtaagtttaagggaagaacgttagtccgtgcgattctgtttctgccgatcatcatgaatgccggagcaatcaataatgcgatcgagatggcaagggaggcggttaccggtggtgttgcagcagtatctgcggaggcggcagttgcatcgggtgtgaatgtagactattttatgaacctgtttatggatctcggatttccggttgcactgctcgattatatcacagcggcagtcggacggatctttgacattgtgcaggcgtccggcgtgcagatcattatctttatcgcagcactgcagtccgtgccgggagcgttgtatgaggtggcaaagatcgaaggcgcgacagggtatgagacattctggaaagtgacgtttccgatggtatctccgcttatcatcacaaatgttgtgtatacgatcgtggattccttcgtagacagtgatgttgtggaaaaggcatacgatatggcgtttgtcaattttgactggggcgtgagtgttgcgatgagtttactcagttccgtgatcgtcatcgcattgctggtcattgtatgtaagctgatttcaaagaaagtattttactataattagggggtggcagagtatatgaatatcagaaatttaaaagaccagcctctcgatgagattcaggtaaagaaagcgggaagacagatcaagggttttctgatctggctgcttaaggtggtgatcattgtcggtatttcctacattatattaggaccgctgatcacgatcgttgcaaattcattttttacggcaaacgatctctacaatccggttgtcatgctgcttccggcagagggtactctgcagaactatattacatcttttacaagaatgacgtacccgaggacgcttgcgacaacgttcgcctatgtgatatcgctgacgctgatccagatctttatctgctccatggcagggtatggatttgcaagatatgagttcccgtttaagaaagtattgtttggctgtgtgatcttaacgatcgtaattccgaatgatacgctgatgcttccgctttatacacagttccgtaactttgatatcttcggaatcatacatcttgtgacaggacacggcatcaatcttcttagtacggaagttccaatgtatatcatgacagcattgggatgcggactgcggtcaggactttacatttacatttttaaccagttttttcgcggactgccaaaggaaatcgaggaggcagcggtcgtggacggtgcgggatcgttttacacttatttccgcatcatgctggtcaatgcgatgccgtctgtccttaccgtcagcattttctcactggtatggcagtacaatgatacattttatgcaaaattattttccatcaactcaaaattgctcatgagcatgcggatttctactttgcgggcatcgatcgagtttatcgatcagatcaaggatacggcagtgtcacagctttatctgtatgccggaatcgtgttgatggtgataccgatcgttattatctacattttgttacagaagcgttttatcgagggagccagccgcagcggtatcgttggttagaatggtaacttcgaaaacaatatatttttatttataagaaggaggttttcacatgagaaggaaaacagttggaaacaaggtggtttcagtacttttggcaggtgcacttgcagcatcacttgcagcatgcggcggaaatactgcgaacacgggggcagatgcaggaaataacgcagcagatgctggcacaaaggaagatacaaagagtgcagaaaccgaaaccgcagcagatacggaggagagttcagatgcagcagtggctgacagtggctacgaggcaaaggatttaggcggaagaaccataaagatcggtctctggtgggatgaatactgggacagcaattatcagtctttagatgatatcgaagcagcaggtggttcctggacaaatgaggagaccatgcagatgaaacttgatgcagtccgtgccgtagaggaaaaatggaactgcaagatcgagtgggtaaaccttggatgggatggaatcattgacagcatcaatacatctgtcacagcaggtacaccggactgcgatatctacctgacagatcttcagtttggtatctcaccggttgcaaatggatatgtacagaaaatttctgattatgcaccggctgactctgatatcctgacagacggaaccgtatttacaaaacagaacctgctcggtaatgatgattatttattccatgaatcaaccacgatcccatccggtgccatgtatatgacatacaatgcagccatgatcgattctttaggtttagaggcaccggaatctcttgctgaaaaaggagagtggacctgggataaatttgcagaatatgcaaaagcatgtacacaggatacggacggcgacggcaacatggatgtatacggatacggcagtgcatggactctgactgttcagggattctgcgcttcgaacaacgctacaatcgcagattcctccacagagggattaagtgatcctaagacggttgaggcgttcaactttatcgaccagttatacaatgtagataaatctgcaagaccttaccaggatgactggaacaacgacctcttagctttctcttccggaaaagtagctttcgcatttgcacagccatggatcttaatccaggagatcgacaatcatgattttgatatgagaatctgcccggcaccggttggaccaagcggagatggaagcatgacgccggctatgatcacaaacaactatatgattccggttggtgttgaggatgcaacttctgtttactgtgtatttgaggagatgatgaactggtatcatgatgatatttcttatcgtgatgatccggagtggtttgagtctggttttgttgatgaggatcaggttacacttgcaaacaaacttggcgcacttgcaaataatgatctctggaacagcattgactctgagggtgcagtcagcaaagtattttacggtgatgttgtaaatggcgacagcacagtatcacaggcgattgagtctaacaaacagatcttacaggatgagattgatacgttgaagatccagtagtgaactggtatgatctggatgtcaaaaggtattccgtgtttggcataaccttttgacatccggagcagaatcaaagtatttattaagaaagaactgtgcaaaagaaatatttgaccgatatctgttttgcagaatttttttcagggaaaaggggcgaagaacatgaacagtatgtttggaccggagacgaagttttttaaggtgacaaatcagattggaaatatacttttagtgtcggttttgtggctgatcggatgtattccggtcattacgatcggaacatcgacgatcgcgatgtattatgcgatggtaaaagccgtgcgttgtgaggaagggtatgtgacaaaagagtttttccgttcttaccggcagaatttaaagacagggatcgtgctgacggttatttttcctggattggcagcggtgctgtggcttgatcacagttatacggtaaagcaggtttcaatcgtggcaggggcacttgaaatggtatatcttctgcttgcgtttgtgatcgcagggatcgtgctctatctgttcccggtattgtcgagatttacgatggatgtattttcgtgttttaagctggcgctgtttatggtctttaaacaccttccgacaacgattctgctgttattacttgtggctgttggtgtagtgcttgcgctgttgatcccgatcccgatgatctttgtgatgcctggagtgtgctgttattttggaagtttccttatggagcggatcttaagaaaatatatggcaaagccacagagcaaagaagaggaagaaaaatggtattaccggtaagcggttttaggaggaattcagatggcaaacgtgactatgcgtgatattgcggaaaagctgggagtcagtatcgtctccgtgtcgaaagcactcacgggaaaagaaggagtcagtgaggaacttcgtgaaaaagtaaaaaaggaagccgacaggcttggatatcgttataacctcggagcaaagggtcttaaggagggaagaaactataatgttggtgtaatcattccttcctactatacagatgacacgagcaatgcattttatatgaaaatgtaccagtgtgttgcaaaatgcctgaccaattacgattatgcgacgatgttggaactggtggatacgaggatgcaggaaatgatgatcctgccgcagattgtgggggataacaggctggatggactgattctgatgggagagttagacgagacatatttaaaaagattaaaacagatgaatattccgatgatctacatggatttttatgatctctccatggagacggattctgtcagcatggataatatcagcgcggaatacaagatgacggagtatttaattgaacttggacataaaaagatcgcctatgtcggttcgatcaatgccactacgagcattatggatcgttatttaggatatagaagggcattacatcattataatatcctatatcgcgaggattatctgattgaggacagaggtgaggacagactttttaaagaactggctctgccagaggatatgccgacggcatttgtctgtaacaatgatgaaattgcctgtatcctgatcgaaaaattagaaaaaatgggatacagtgtgccggaggatatatcggtcacagggtttgacaattatccgtttatccgacgcaatgcgtcgggactcacgactgtggatgtggatatcgcgatgatggcgtccgagggcgtggagcttttgttagaacgcctcaatgataaacgggaaacatttgtgagacgtgtcgtaagcggacatattgtgatccggaaatcgactgggaaagcggcgacagagccgtaaactgagccagagaagactgggaaagcggcgacagagccgtaaataagtcagaaagcggattaacagaattataaatgaaatgagtcagaaacggcagaacagatgccgctatgaataaaaaggggaaggagcgcacgggttttattgtcagaaacataaaaacagaaaagagagatgcgcagaatggaggagcagacaagatgggaaatgtaaaaatgatcagtccggcagtgccgaacatgccgtggcaggagaggccggagaaaatcgtaaatgcgccggtgtggcgctacaaggagaatccgattattggaagaaatccggtagaaggggtggcaaggatttttaacagcgcagtaataccgtatgaaggaaaattcatcggcgtattccgtggggagcagacgaatggaatcccgtatgtttacctgggaagaagcgaggatggtattcattgggattttgacaaagacaaggtacgttttgtggatgaagaaggcaatgattttatgccggtatatgcgtatgatccaaggcttgtaaaagtggaggatacctattatatcatctggtgtggggatttttacggtgcagcgatcggaatggcaaaaacgaaagattttaagacatttaccagaattgaaaatccgttcctgccgtttaaccggaatgctgtactttttccgcgcaaggtaaatggaaatttcctgatgctgtcaagaccttccgacagcggacataccccgtttggtgatatttttataagtgagagtaaagatcttacctattggggaaaacaccgtcatgtgatgggacgcggcaatgaatggtgggagtccttaaagatcggaggaggagcagcaccgatcgaacttgaggatggatggctgctgttttatcacggtgtcagtggaacctgtaacggatatgtatattcgattggcggggcgatcttagacaaagaaaatccatctattgtaaaataccgctgcaccgatttcctgttaacaccggaagaatggtatgaggaacgtggatttgttccaaatgtctgtttcccgtgtgcaacgatccatgattctgcaaccggaaggattgccatttattatggggcagcggacagttatgtcggtcttgcatttacaacggcagatgagatcatttcatatataaaggaacacagtgtgacaggggaatctgatacggagattggaagaagataaaacttgaagcaagttgttccctggcaaaacaaattgttttgaaatgaggattattatgaagttaaataagttgggaaagttcgccgcactgtgtatggcaggatgcatgctgcttggtggctgtggcgcagaaaatccggcagatgaaaaaacggtgacgggcaatgccgctgatgtgtcggcagaaaaaagtgagaccaggatggattctgaaaataataccacagaaaaaaatgatatggcagcagaagatacagcagcggagacagaaagtgcagaaacagaaacggaggatagtggtgtggcgataccggaagttgtaattgaaccgaaggagatacctgatacagacggaatgaaatttgtgcgggatatgaagatcggatggaatcttggcaacacatttgatgcaattacgaatgcacagaaagaagatgatctcagtattgagtggtcgtggtgcggcgagaagacgacaaaagaaatgatcgatgcagtaaaggcagcaggtttcaaaacgcttcgcctgccggtgtcatggcataatcatgtatcgggagatcattacacgatcagtgaggcatggcttgacagggtgcaggaagtgttggattatgcggttgatgatgacatgtatgtgattttaaatatccatcatgatacggataaagagtactgttacccggacaaagagcatttagagcagtctctttcctacatgactttcatttgggagcagcttgcagaccgttttggagattatgacgagcatgtgatctttgagagtatcaacgaaccgcgtctggtagagacagatcatgagtggtggctggatatgaatgctgcggaatgtgtggaagcagtagaatgtatcaacgagtggaatcagaactttgtggatgttgtgcgaaagacagggggcaataatgccacacgttatctgatggtgcctggctatgatgcctctgcggatggggtgttgaatgacaagtttgtgctgccgacggacactgcggaaaatgagggaaagatacttgtctcagtgcatgcttacattccttatcattttgcattgcaggcggcaacggaaaatgagagtattgatcagtttaatgcttctgaaaagacaagtaccaacgatatcgaccagatgatggaaaaactatatgcgaaatatataagcaatgagatcccggtcgtgatcggagagtttggtgcccgggataaaaacggaaatctgcagagccgtgtggactatgcggcatactacattgctgcggcgcgcgcttacggcatgagctgtaactggtgggataacaatgcgtttaccggggacggcgaactgttcggactgctcgaccggaaaacagttacctggagatatccaaagatcgtggatgcactgatgaaatatgcagaataacagattccatgtcatgaattcatgggtttataatggttttgtaataaagtcagaactcttgacagaaaccataagattttatagaataatgtggtcatcggagggtttataatacttacgatattatgagctggataagaagccgggtggaaatcccggtttcttattcagtttttttatggagagttttatggaacacgattttacaagcggaagcgtatggaaaaaattgttattatttgcagtgccgatctttggagcaaaccttttgcaggcactctatggaacggttgatctgtttgtggtcggcttatttgcggatgcatcggcagtttcagccgtgtcgaccggaagcatgacgatgcagacgatcaccgggatcatcacgggacttacgatgggatgtaccgttttgctcggacagaatatcggtaaaaaagatgaggcggcagcggagcggacagtcggctctgcactctggctgtttgtcacggtgggaatccttctcgcagtgatcgttgctgtattggcagtcggaatcgcatctgttataaatgcgccggcggaagcattttcccagacgaccgattatatccgtatctgcggaatcggtatcatctgtatcgtcatgtttaacgcaatcggtggaatgttccgcggactgggggatgcgagaacaccgttagccctcatgggtgttgcatgtgtcgtcaatattgcaggtgactttgcgctggtcggcgcactgaagatgggcgtggcaggggctgcacttgcaacagttgcggtgcagggaattttaagtacttttcttgtgagaatccctgtttcgtacgcgatgagtaaagtgtctggcgtgacattgttccagatcggatttgcgacaccgcttgcaactgtgtttggactcattttgagtgcttcctgtgtgatttattatgagagaaagagaaaaaaagcataaaatgattggaaaaactgccaaaatgtattaagataataggcgaacaaataaagaaatgagatctcagaaatgaatataaaacaggcaaaagaagaaattaagcatacggtaatggcttacctttcgaaggatgaacagggagaataccgtattcctgtgatcaggcagcgaccgatccttttgatgggaccaccaggcatcggaaagacacagatcatggaacagatcgccatggagtgtaagatcggtctggtcgcttatacgatcacgcatcataccagacagagtgcagtcggacttccaatgataaaagaggaatctttcgatggaacaacgtatccggtcacggagtataccatgagtgagatcattgcaagtatttaccgtaaaatgaaaaagaccgggcagaaagagggaatcctttttattgatgagattaactgcgtttcggaaactttagcaccgacgatgctgcagtttttgcagtgcaagacatttggcaatcaggcgattccggaaggctggctgatcgttgcagcgggaaatccgccggagtacaataagtcggtgcgtgattttgatatggtgactttagaccgtgtccgttatctgaacattgaagctgattataaagtctggaaagaatatgcgagagcaaaacatcttcataatgccattttaagctatctggaactgagacagaaaaacttttaccgtgtggaggcagatgtggatggtatccgtttcgtgacagcgcgtggctgggaggacttgagcagtctgatgcaggtttatgagaaactggatctgccggtagatgagagtgtcatccgtgagtttatccatcacgaggacgtggcagaggatgcagcagcatattttgaactgtaccgcaagtaccgggatgattacgggatcgcggatatccttgccggaaaagtaagaccggagacctttgcaagaatctatgcggcggcatttgatgagagactgagcgtagtgaatcttttattggacggtctgtctgcattttttggaaatgtacaggaaaataaacagatcgcggataactggtacggatttttaaaagaatatcagagacggctgaaagagggcgaagcgccggtggacagctatcgggcattgctggaagaaagaatggcagtggtggaagctgagaagcaggcggaagtctgtacaaaggcacaggtggcaggatgggagcgcatttttgcattctggaaggaaaatacaccggatagcggattagatgtgaaagagagttttgcacaggcgaaagccgggtttgacagacaaagagaaacattagaggatgcggaaaagaaagcgatgaatgcattagagcatgcgtttgattttatggaacaggcgtttgaaaatggtgaggagatggtcgtgtttgtgacggaactgacgttatcaccagaagcagcaatgtttttagcagagcatacctgtgagcggtatatgacatataacgaacagcttttgatcggaaaacggaaaagagaactcttatcagaactgaatcgctaggaaatacacacggcgcaggcaacagcgcaagaatggagattaagatgaaacagagtgaaacaagaaatcttacaatgatgatggatctttatgaaatgacgatggcaaacggttatttcaacgatcaggacaaggatacaagagtagcatttgatgtattttaccgcagcaatccggatggcggcggatttgcgatttttgcagggttagagcagattttagagtacattgagaatcttcattttgatgaggaggatatcgcatatttccgttctcttaacatttttacagaagattttcttgcttatctgaaagattttaaattcagcggtgatatctatgcgttcaaagaaggaacgatcatgtacccgaatgagccgatcatcacggtggtcgcaccgttaattgatgcacagctcatcgagaccgctttgcttgcgcaggtgaatcatcagtccctgatcgcgacaaagacaagacgtattgtgagtgcagcagagggacgggctgtctctgattttggtgcgcgccgtgcccacaacatggatgctgcagtttatggtgcgagagccgcatatatcggtggcgcagtcggaacggcaaccgtgcttgccggtcagatgtttgatatcccggtcagcggaaccatggcgcatagctgggttatgtattataaggatgagtttgaggcatttaaacattatgcggagaattacccggatggaacggtacttttggttgatacctacgatgttatcggttccggtatcccgaatgcgatccgtgtggcaaaagaagttttagagccgatgggaaaaagactaaagggaatccgtatcgacagtggtgaccttgcatatctttccaaaaaaatccgtaagatgttagatgatgcgggattagaggattgcaagatcgtcgtttcaaacagccttgatgagtataccatcacgtctattttacagcagggcggaaagattgacagcttcggtgtcggtgagcgcctgatcaccgcaaaatccgatccggtatttggggcagtatataagatttcagctgtggaagaaaacagaacctttgctccgcgtatcaagatctctgaaaatgtggagaaaatcacaaatccgggactgaaagatgtataccgtatctatgatgaagcaggacattcggtggcagatctgatcacaaaggcaggcgagactgtggatatgttaaaaccgtaccgttatgcagatccggtaaaaccgtggaaaaatcgttcttttgaaaactgtacggcgaaaaaactccaacagcaggttgtaaaggccggaaaacggatcgtggagccggaatctttagaggaaatccgtgcctatgtggaaaagcagcttaacaccgaagtgtgggaagaagagcagcgttttgaaaatccgcatgagcattatctggatatgagtccggcatattatgagatgaagatggatatgctgcacgagtcgcgcacgagataacgtgagtcaaaaatgaagatgctgcacggactgacagtataagtgaagataaagcagcatacctgtaagatagtaagaaacagatagtaaggaaagaataacgtgaaattgatatacgacatcccagcatctttttggggactgttccggtccgtaaaccgggacatctatatagaagcacttctgaccatcaatgacgaataccagtacaacaattactttttaagcagagaagcatgtgtccagatcttaagcgacatgtgctcctctcgtcgttatgcctttatgagggaggataatgagacagaggaagatgaggagaccgcattgccgggtcgtatcttaaactggctggtgcgcacaaaatggctcagaaaaatcgaagattacgaagcgatgaccaccaatatcgtcataccggattatgcggcggtgatgatcgaggcatttgaaaaattggcagacgagccgttagatgacacggatctttatatccagaatgtctatgcgacgttgttttcctttaaaaatgatcaccgcatgaatcttaccatgttaaaaacggcacttgtcaacacgaagaagctgaataaggcattgcaggacatgcttcataacatggataaattttttgagcgtctcttaaacaaacagtcctacgatgaacttttaaaggagcatttagagggctatgtggaggaagtagtcagacgcaaataccatattttaaagacgagtgataatttttatatctataaaatggacatcaaacgctggctgaaagaaatgcgggaagatgatgcctgggtggagcgtatccggcagaaacagcatatggagcaaaaagctacggaggacagggcttctgtgttagattctaagcgcacggaagatgaacttccatttttatatacgagaagaaacaggcaggaggatgtgctggatctgatcgatcagatagagcgtggatttgatgatatcgagcaccggatctcaaatatggataaagagcacagcaaatatatccgtgcgaccgtgagccggttaaattatctgctcagtgacgagacagaacggcacggtatgctgatcttacttttgaataaacttggatcggctgagacggagagtgaacagagtgagatgttaaaagaggtggcgggacatatgaatctgtcatcttttgatgttttgagtgacaatccgctttataagagaagacgtcgcagaaaatttgaggatgatctgcaggaagaggaggagccgatggagctttcgagggaagatgtcctgcgcttaaataagatcgaacaccgctatacggcaaaacagatcgaggaatttattgacgaacagatggcagacggtgtcttagagacagaccggatgaatatttcggatgacgaatcttttgaaaaattgatcctcgcttacgatatcagtatgcgaaagaacagcagataccgggtacaggtggagaatgaacaggtttcgaatggaaattattgttatccgaagatgacttttcgtgtaaagcaaaaatcaatagaaagtgaacagaattaatgtttgaaggttacgaagaattaaacacgcaggatgtggagtggatgcaggaagtgataagaaccttacttgcccagacatttctgccggaacgaaaatatgataaaaaatacggacgtatgatgccggatcgcatgtatgatttttgcgacaggcatttggaatttctgacggagtattttgcggttgcagggataaaactttgtcaggatacagagcttggaatcatttatctggagggaacagacggaatcggggagaaactgccgaaacttgcgaccatttatctgctgctgttaaaactgatctatgatgaaaaaatggcggcggtttcttccagtgtcaatgtaataacgacgtttggagaattaaatggaaaagcgggagaattccgtctcatcaagggaccgtcatcgatgacggagatcaaaagagcgtttgccattctgaaaaaatatcagatggtagagtttttggatgtgtttgacgaacagcttgaaaatacgaggatcatgatctatccgtgtatcaatttagtattgatgagagaagatgtgaacgggcttcttggcagtttttccgatgaggtaaaagataacgaggtagacgggcaggagaatctggagtggagcagtgaggaaacactttcagaaaatgatatgacggatgaagaaagtgatcttgaaccagaagaaatgaatgtggatgaggaaggagagacagaagatggaacagatgaatcaggcatataaagtttttaccagaatctgcctcaacaactggcattatattgaccgcaaggtgttaggcttaaatgagagtatcaacttttttaccggtcattccggaagtggaaaatcaacagtgatcgatgcaatgcagatcgtgctttatgcgaacacggacggacgtggatttttcaataaggcggcggcagatgactctgaccgaagcctgatcgagtacctgcgcggtatgatcaatattggcgagaataatcaggcggaatataagcggaacaaaaacttttccacgacgatcgttcttgagatggaacagacaatcacgaaggaaaaagaatgcatcggggttgtgtttgacgtggagacggcaaccaacgagatcaatcgtttatttttctggcacaagggagaactgatcccgggggattaccggaccaagagccgtgcaatgacgatcagtgaggtgcgcagctatttgcagcagaatttcccgaaagatgagatgttttacacctcaaataatgagagattccgcagaaacctgtatgacgtctacttaggcggactggatatggaaaaattcccgcgcctgtttaagcgtgcgatcccgtttaaaatgaatatccggttagaggactttgtaaaagaatatatctgcatggagcaggatatccatatcgaggacatgcaggagggcgcgatgctctatggcagaatgtgccgcaagatcgaagccacgatgcaggagatcgaagagttaaagcagataagtgcgcagtatcaggcgatggaggagaagaaaaaagaacttttaaactgccattaccggatggataaactgacgatcttacagttagagcagaccatagaggaaatgcagcaccgtgtggaaaactggaaaaaggatgttgtactgcagaacgaaagtctcgccgaactgcttgaaataaagggaaattatgaaaaagagtacagcgagatcaatgagcagatcgcaggaaccggttatgcaaggcttgaagagcagttaaagagtctggaagaaaacttaagccttttagagcgaagtaaaaataagtgggatggtatctgtgcaaggttaaacggctgggaagatgtagatattgtttcgaatcagatcttatgggatatcgagaaattcaaagaaggcacgatcaccggcgaggagatcgagcgtttaaaacgaagcctgatcgaagtgcagaaagaagcggaaaaagacagacaggaagcttccgcagaaatccgttccatgaataaagaggcagatgtgttagagaaagagcttgcagagttaaaacttggtaagaaggcatatccgcgggaattagagcttgcgcggtctgaaattgcgagaaaactctccgaacagaccggaaaaaatattcaggtacgcatctttgccgatctcattgatattaaagatgagacatggcgcagtgcgatcgaggggtatctttcctggaataaacttgcactcatcgtggaacctgcctacgtcaaacaggcgatggaagtatacgagacactcgatgaaaaacggtttttccgtgtgtctttggtggatacggaaaaactgatgcaggaggagtggcgcataaaggataatgcgctcgcggaggaagtggaggcaaaagagccgtatgtgcgggcatttgtggatttcctgcttggaaatgtgatcaagtgtgcttctgtcgatgaactgcgccagtgtaagatcggtgtgacggcagactgcctgttgtaccagagttatcagttacgacggttaaatccggacaattataagaagtatgtatatatcggtgaaaagagtaaaaaacagcgccagaaggaacttgccgtcagccttgagaaattagagcaggacagagcggaatataaggagcgtgagacagaggcgagaaatatccttgcccaggaatttttaaatgatacggttgaggaataccagaacctgatatcagatctttcggagaagaaagaaaaggaaaaacaaaaggcaaaaacagaaaagaaaatggcagagatcggtgccggtactgttgagatcttaaagaaacaggcagaagagattcacaaaaaacaaaaagatctggaagataagatcgatgacttaaaataccagatccggaaaaaagaagatgccattgaaaaagacagcagtgatttcattacaaaaaatgaggaacttcttacgaaaaaaagagagcttcgcggttccgctgcggaagaagaggcatttgaggtttatattgccgggcagaaaaataaaaaatatgacagcctgaaagcatcgacacaggaagaaatggaacaggtgtccggtcagtgtgatgtacagaaaaataaactggtggatgtacgtatgaattatcttcagaatcatccaaaacgtgatttctcagcgagcgcagagaataatgacgattatgacagcctgctgtcagagctttcctgcaatgaactggaagaataccagaaaaaggcagccgagcaggcaaaggcagcagtggagcattttaaggaggattttgtatacaagatccgcagcgctatcaaagaagcctatgtgcgcagggatgaattaaaccgtatcatccgcaacctgaattttggtaaagaccgctatcagtttaagatcacgagaaataagggagcagacggtgcattttatgacatgttcatggatgaggatttagagatcgatccgtcctcacttgcatcgccaatggagcatcagatgaatctgttttcgatggagcatgaaaataaatatggtatgttgatgagtgatctgatccatatctttattccgccggaaaatgccacgcagcaggaacttgatgaggcaaaacagaacatggtgaagtatgcagattaccgtacgtatctttcatttgagatggaacagatcgtggaaggtgacgaacgtcttgtcattggtcttagcaagatgatcaagaaaaattccggtggtgagggacagaacccgctttacattgcactactcgcaagttttgcgcaggcataccatatcaatctgtctgcaagactgacaagacgtccgacgatccgtcttgttgttttagatgaggcattttccaagatggatgcagagaaagtggcgagctgtatcgaactgatccgcgggcttggttttcaggcgatcatcagtgcaacaaacgataagatccagaattacattgaaaatgtagataagacattcgtttatgcgaatccgaataagaagagcatttcgattcaggagtttgagaaaaaggatttttcacagttggttgtggaggaggagtaagactatgcagacatcggcagagttaaaaaatttattacagcgtatcgatcataagggatatccggcatataaggacacaagaggttcttatgaatttccgggatatgtgctttccattgaccatgtgcagggagatccgtttgcagcaccgtcgaaggtaagtatccatgtccgcgggaaacaggcgggattcccggaacatctttatcagaaagactgcagaaggaccgccgtgcaggattatctgctgcgccagtttgcgcgccaggtcgagaaagtttcctttaaagcgaaaggatctggaaagagcggccttatggcggtcagctgtccgggacaggaagtgttagagcgcagtgcctgccagatggatgcaaagaacggcgatatcgtgctgcgtatggagatcggtttcccggcaaacgggagaacggtcaattccagggagttagaaaagatcttcttcgatttcctgccggagtgcgtaaaaggctccctttatttccgttctctgaaaaaagaagcggtggagacagccgcagatctcgccgaggatcaggcgtatatcagggagcagttagatccgatgggactctgtgcgtttgtggcggacggtgcaatcctgccgcgggagtccggtgtctccggcagaccgatgaaagatgcggtgcgttttcagtcaccggaaagtctctccgtcacgctgacgctgccgcaccacggaaaactgaccggaatgggaataaagaagggcatcacgctgatcgtcggcggtggttaccatggaaaatcaacactgttaaaagcgcttgagacaggtgtctataaccacattgcaggggatggcagggagtatgtcatcacggacgatacagcaatgaagatccgtgccgaggatggaagaagcatccgtgacgtggatatttccatgtttatccatgacctgccaaacgggaaagatacggtatccttttatacggaggatgccagcgggagtacttcccaggcagcaaatgtgatcgaggcgatggaggcaggcacaagagcatttctgatcgacgaggataccagtgcaacgaattttatgatccgtgacgaactgatgcagcgcgtggtcaaccgtgatgccgagccgatcgtgccttttattgaccgggtagaggagctgtatcacacatacggtatctcgacggtccttgttgccggaagctccggttcctattttcacaaggcggactgcatcatccagatgaaccgttacgagccgtttgagatcacagagtcagcaaagcaggcagcggcagagttcccgcttccaaaacaggacattgcccagtcaaagcagcctgattttgacagaaaaataaagccggaccggatgtttcaagaggacaaccgcttaaagatgaaaacgatgggaagggattccatctctatcaaccgggaagtcattgacgtccgctatgtggaacagcttatggacacggagcagcttgcagcactcggatatatgttaaaatatatgcagatccacttttttgatggaaaacacaccctgacacaggcagtcgatgcgctttgggatgttttgcagaagaaggggatcgcagcagtctgcgagagtagttatctgccgtgcggacttgcgatgccaagaaagcaggaagtgtttgcgtgcgtgaaccggtatcggaggctggggctgtagggatgaggcattgttagagatatgccggaacagcaaaaaataatctcccttctgttggattacttaacagtgttggttttcaactggttggaacagagcagatttcgtttcataaagacagtgaaggaaatgatatttattttgaaggtggaaattttgtgaaggaactgtgctgagcggcatcttgtgtctgtcagttttttgtgatggtggaaaaaggcagagctgtttggacttgttatgaaaaaactggaatagattagagaggggggaaaatatgaggtatttaccgatattgggagaactctttgcgtctgatacgatcatctttttattgatcggttttgtgatcttttggaactgatactgttgtttgcaggcacgattgcgcttggtggaatactggactttttcgccgggattgttgtgtctggagtgcggaagtgttgataggattgtggcgggaaatgaaagtgttgttagggatattttagcgcaaacgccagcggacgtctgcggaaagtgatcgatgacaatgcagggttgaccgaaaattttctggcacatcagcttcctgacctgaccggggcagtggtaatgctggtcgcagtgtttgtactgatcttttaaaaatttccatgctgcgatcggtgagcaggataagacgaataaataaggagtaccatcatggaaaccaaccataatgaaccaaaatatatcggggtaaaaggggcgagagtccacaacctgaaaaatgtaaatgtggatgtacctctgcatcagattgtgggggttgcaggtgtctccggttcgggcaaatcttcgctggcacttggtgttttgtatgcagagggttccagacgatatctggagtcactttctacttatacaagaaggcgtatgacaggagcggcaaaagcacaggtggacgaggtgttatatgtcccggcagctttagcactccatcagcgtccgggaataccggggatccgcagtacgtttggaaccggaaccgaacttttgaacagcttaaggctgatgtattcgagactggcatcccaccgctgtccgaatggacattacatagagcctacgttaaaagtagcggcagagcaggaaatcttatgtccggtgtgcggggaaaaagtacatgcaccgagtgcggaagaacttgcctttaattcacagggggcgtgtcaaagatgcggcggtacgggaagtgtgcggacagtggattttgattcgctggtgccggacgattcgatcagcattgatgagggagcggtcgcaccgtggaacagtctgatgtggtcactgatgacagatgtctgccgtgagatgggtgtgcgcacggatgtcccattccgggaactgacagacgaggagaaagagatcgtctatcacggcccggctgagaaaaaacatattttttataaggcaaaaaaatccaaccaggcgggtgaactggattttacctattataatgctgtttacaccgtggaaaatgcgcttgcaaaagtaaaagatgagaagggcatgaagcgcgtggaaaaatttttaaaggaagatatctgtccggaatgtggcggcagcaggctttctgaagctgcgagagcaccaaggctccgtgggataagtctggatgaagcctgcaaaatgaccttaaaagaactggtggactgggtggcaggagtgccggattccctgccggaagaaatgcgtcccatggcagaatccatctgtgaatcgtttcaggccgttgcgaaaaggctgatggatctgggactttcttatctgtcgcttgaccggacggcctcaacattgtcgaccggagagaggcagcggatgcagcttgccagagcggtacgaaaccgcacgacaggcgttttgtatgtgttagatgagccttcgatcggtctgcacccgtcgaatatcaaagggcttaatgccgtgatgcatgatctggtcgcggacggcaattccgttcttctggtagaccacgatacacagatattatcggaggcggactggctgatcgagatgggacccgaagccggtgtgggaggcggatatgtgatcgcggagggcagcattccgcagattatttccaataaaaaatccatgatcggtccttttctggcgaaaacggcagatatgcatgtccgcacacaggcagggaaagaggaagtttttacacttggaaaattgcatctgtctacggataacattcacacggtaaagccattggaagtggatattccaaagggcagacttaccgtggtgaccggtgtttccggttcggggaagaccacgatggttttagagagtctgattccgggactggaagcctctttttgcggggaacatctgccgaaacatgtgaagagtatttcggcggaaggaattgcccatgtgaaactgatcgatgcctcaccgatcggtatcaatgtccgttcaacggtggcaacttatgcaaacatacatgatgaactccgcaaaatctatgcaaaaacagcggatgcgaaagaccggaaatacaaagcgggggatttttcctacaatactggaaagctgcgctgcccggtctgcgacggaaccgggcagatcagtctggatgtacagtttttaccggatgtggacatcccatgcccggaatgtggcggttcccggtacgcgaaagaggcatggcagatcagctatgaaaataaacagggaaacaggtattccctgccggaactgatggagatggatgtcaatacggcgctgcaggcagtcaaggatctgaaactggtgcaccagaggcttggtgtcctgaaaaatttaggacttggatatctgacgctgggggaggaaacaccgagtctttccggcggcgaggcacagagactgaaacttgccagtgaaatgggaaaaggacagtcggattctgtctttgtgtttgatgagccgaccatcggactgcatccgttggatgtacagacgttacttggcgtatttcaggcgctggtcgataacggggcgactgtgctcgtcattgaacatgatctggatgtgatccgaaatgcagattatatcattgatatgggccccggcggtggagaggagggcggcagagtggtcgcctgcgggacaccggagcagattgcagcgaatgaggagagtgttacggggaaatatctataaagaataggggttgcgtttctcattcatttctgctacaatgaccacgtcattttcagacatatcaaaattcaaattttaatggaggtgaattttcatggacagttgcgatagcgtaggacgaagtaaaatatgcgatgtacgaagatgtaaaaaaagaatgtggctgtctgtgaaagtctgaccgccatattctatattgttgtgcacctttttatacatcgcatcagaggatccttgcaatcacaatgaagcgatgtatttttatgcccatttcaggcgaaaaggaggtcacaatgagaaaagtattaatcccgaaaaaagactatgtaaaagaactgataaagatcatccgtgttacaaaagatgagcagaaattacggaatctgctgtcagattatcatgagaaagatatcgcggaggcaatcacatttctgacggagactgagcggaagcatctctaccgtgtgctcggctctgaaaggatcgcagagataatttcctattttgatgatgcggaaatgtacttggaggaactgtctttagagcaggcagcaaaagtaatttcctacatggatgcagatgatgcacttgacgtgttagatgatctgtccgagtcaaagaaaaatgagatcgtgagccatctggatgcggacgcacagaaagatgtgcagaaactgctctcctatgaggaggatgagattggaagctgcatgacgaacaactttgtctgtatttcagaggagctgtccgtccgggaagcgatgagcgaactggtccgccaggcgggggaacatgataatatttcaacgatttatgttaccgatacagaggaaaaatttgccggtgcgatcgatctgaaagacctgatcatcgcgagagaaaatacacctctgcaggagatcgtcagcagttcctatccgtatgtgtatgaacatgaaaatatcagtgaatgtgtggaaaagattgcagattatgaggaggattccatcccggtactgacacaggatggaaagatagccggtattctgactgcaacagatatcgtggagttagtagatgatgcgatgggagatgactatgcaaaacttgcaggtctgacctccgaggaggatttaaaggaaccgacgatcgtgagtatgaaaaagagactgccatggctgatcatattgttgttccttgggatggcagtgtcctctgttgtcggaatatttgaatctgtggttgcagttctgccgatcgtgatctgctttcagtcgctggtgcttgatatggcaggaaatgttggtacgcagtcgcttgcagtaacgatccgtgtacttgtggatgaggatttagataccagaaaaaaactggctcttcttggaaaagaaatgaagatcggctttttgaatggagcgagccttggcgtcatggcacttgtatttcttggcatttacatccacctgttcaaaaaatatgcctggatgtcagcattcctgatttccgggtgcgttgggatttctctggtcgttgcgatggtaatctctggttttgtaggtacgatcatcccgatgttcttccacaagatccatattgatccggcagttgcatccggtccgctgatcacgacggtgaatgatctggttgcagtaatcacttattatggattggcgatggtatttctgatcgatatttttcatatttaggaggaacggagatattatgaatacacaaaatttaagaaccctttttccaactgtaacgaaacaaaaaatactgaatctgtcatatggcgagggagaacattatacagtgcttcccatgattgcccaaaaagaggatacattttatctgtgggaaatttcagccatgtcggaacaggaatatgaacacagaaacggaacatacaaagaagcgaagacaaaccgggcagagttaaagcagaatctggaagaagcagaccaggtgtggatcgaaaaaattgtaagcggtggctgctgttttgaggccgcttcagcaacaggcacctgtcttggcgagcgatataatatagaggaacagatacagtttttatatatgcttggacagggagcggagttgggggagttagaacaggtggagcttgacaggctgtttatcacctgctatgaactgacgggaaaagacgggcagaaattatccgaagaagcattttggaatatgggaaatgaggatgttacggttacgctgtcagaacagcaccgatctgttctggtacaaaaaagattccgcttaaagatcggggaatatgcaaaacccaaagtgctccatctgaccggagaggcagaaagcagtgtttatattcatggcatccggttccatgatgtctggaaagaggcggagacacgttttgaagataaacgatatctggaacatttcagcaaagaacagattgcacagatgaaacgggaatttatggaacttctgccgcagatatgtcccaaaggctgtgtcctgcccatgatcgaatacgagtgcgacagggattatcagatgcagttttatacgacggaatatctgaaacgcgcaccaaagcatcattctacggcattatttttcgcgatgcgtccggacacgcagattggaccgatgggatacaaaaacagggtatgtcagttagaagcaatggaggaaggctttgagggagagatatccgttgagatatttttgtgtcataaaacaataccgggagaagagaaaaaagcaaggcattaatgcaaattttgtgttatcatgagtgcaggtgaaagaaagcaagagggattgttttatgacacagactcatataaatattgcaatgttagcacatgttgatgcaggaaagacaacattgtcggaagcgttattatataaaagcggcagcatccggaaagccggacgtgtggacaataaagatgcgtttttagataccaatgaaatggagagaaaccgtggaatcacaattttctccaaacaggctgttttttcgtatggaggatgtgaatttacactgttagatacaccgggacatgtggatttttctgcggaaatggagcgtaccttgcaggtgcttgactatgctgtgctgatcataagcggtgcggacggtgtgcagggacatacgaggactctctggcgtcttctggcgcgctatgatattccgacatttatttttgtcaataagatggatcagctggggacggatcacgaaaaattattagatcagatcaaggatacattgagcagtgcctgtgtggatttctcaaaaaatgaagacggaacttaccaggataaggatttttatgaaaatgtggcggtctgcaatgaaaaagtgttagaagcgtacttagaaggcggcagtatcgaagatgaatctgtccgtgaaatgatacagaaaagggagttatttccatgtttcttcggttctgcactgaaaatggaagggatcgaggagctgctttttgcactttccgaatatacgaaaatgccggagtatccgggagagtttggtgccaccgtatttaagatcacacgtgatgcgcagggcagccgtcttacacatttaaaagttacaggcggtgtgctgaaggcgagaaatctgctgtcaggacataagcagaataaagcagaggatatctgggaggaaaaggtaaaccagatccgtatctattccggtgaaaaatatgagacaaaagatgaggtggaagcgggaaccatctgtgccgtgaccggattatcctacacctatccgggtgagggattgggaagccaggaggagtccgaactgccgatcttagagccggtgctgacctatgaactgattttgcctgacggtgtgcagccacaggcgatgatgccgaaacttgcgatgttagaggaagaagagccggaacttcacattgtgtggaatgaagaactgcaggagatcaggatacagattatgggggaggtgcagatcgaaatcttaaaagcactgatctcagatcgctttggtgtggaggtggaatttggcaccggaaaaattctctaccgcgagacgattgcagataccgtggagggagtggggcattttgaaccgctgcgccattatgcggaggttcatcttttattagagccgggagagatcggaagcggacttacctttgcggcggatgtcagtgaggatatgttctcaagaaactggcagagactggtgcttacacatctggaagaaaaggagcatgtcggtgtgttgacaggatcgccggtcacagatatgaaagtcacattggtcgccggacgtgcacatataaaacatacggaaggcggcgatttcaggcaggcgacttaccgtgcgttccgacagggattaaagcaggcacagtccgtgctgttagagccgtggtatgatttccggctggagataccgaatgaatgtattggacgtgccatgaacgacattgagggaatgtccggtaaatttgatgctccggacagaaacggggagatggcagtgttgacaggaattgttccggttgcatcgatgcgtgactatgcaaaagatgtgacggcatacaccaagggacatggaagccttacctgtacacttcacggttatctgccctgccataatacggaggaggttgtggaaattatcggttatgattcggaacgtgatctggcaaatccaaccggctccgtattctgtgcgcatggcgcaggatttgtggtcccgtgggatcaggtcatggattatatgcatttggaaagtgtgctaaagccggcaaaagaaacagaggaatggcagccaaagcaggtttacatgcagcagcagagcagggaagaagaatggattggcacggatgagattgacagaatcttaaatcagacatacaatgcaaataaacgggaaaaatctgctccggggcgcaatgtctggaaaaggtcaggagggagcagtgcaaatgtaccgccggtgacaagaacttatacgccgccgctgtcggaaaaagaatatctgcttgtggatggctacaatgtcatttttgcatgggatgagttaaatgaacttgcccgtgataatgtagacggggcgcgtggaaaacttctcgatattatgtgtgattatcagggtatgcgcggatgtgagctgatcgtggtgtttgatgcataccgcgtacagggacacaagacggaaatgtatgattaccataatattcatgtggtttacacgcgggaggcagagactgcggatcagtacattgagaagtttgcacatgaaaatggcagaaagtaccgtgtaacggttgcaacatcggatggattagagcagatcattatccggggagccggatgcggactgatctcggcgagggagttagaaaaagagatcacacgcaaacgtggggaaatgttagaaacatatcaggcaaaacgtgaaccggaaaagaaggtgcatatggcagagcacattccggatgaggtggcagaagcagtcagaaaggcggattttcatgaataaacaggaagaagtaaaatttacacagtccggctttttaaaaattgatgggaaaaaaagagtttcggttcgatttgaacgtggaagtgatattgcagagggcatgcttccgccgggaaaaatcacaaagaatcatggattttccgataaggaagtagcaggattagaaatctatctggagatgaactgtgatgagatctacaaaaaagcgaaggaaattggtaaatttaccaacttactataaaagaatatttccattattattcgcatggatgatcctgcttacgacctgtgctggcagtcagtcggatgttttacgaatgaaatctacagaaaaggcatccggtcagacaatgctctcaggcgagcggctggcaaaaacgtatgatgcactgttagagacagccagaggacgcagcgaaacattagagagtgggagggcaaaagagtttgcatccgtaaactggcgcagaatggcaggcgttacaataaggattctgcttgtcatactcccagcgctgattttgcagttttggagcatctggtaccgcagggctgatgagatcgtgccgcgtggactgctcttagtgaagtttgtgaggagggcggacggaaaaaagaatggcattttagctctcatgaaataaaagataaaaatattattttatgagaggtagaaaaaatgcagattcttatttgggttatgatgatcgttggtggtgccgcaggacttttgtccacggcttatcttgttttggctatgccgataattctggtgtggaagattttccgcaaggtgaaataccatatagcgatctgtgactgatgaagtggatttaaaataacggaccaaaatgccaaaatcctgtatttatgcaggattttggcatttgttttgtgaaactattgtgctggacaagaagaacttatgcgattcttttgtgaagaagcagattatagtatgaacaatcagaaaaatccgattgggattctttctaattggatggagatgaaactttgaaatttcgaatgtgcatatagacagtattttttgaaatatttaactggttggcaactttgatcacagcatctttaagattaaatatgccttgttgatacagacggaaaataatttctttatttttattggaagaagaaatgccgggatcattgtatacggattctttggtttctgtaagtgaaaaaagtatcaggtcatcaatattgtctgaaaaagtttcagaggaagcctgtgttacagaagaggagtcctgtgaaggaagcattccttgcagaaattcggagagtggcatttccatatgaaaatttatgcaaagtaaaccgataatccggccgtgttcgcctgtaataggaattgtacaagagcgaagcattgaatcagaactgcttttattgaaataaggagaaacagtacgtgaaggatcctgttcaagctcccctaacatttttaaagcgagatcggtaatgggagagccttctttccttccagtaaaatgtccgttgatgatttttatgacagagtgatcaagactttctaagctgtgaagtactaattcgtatccgtcaccaaggtatgcaccaagtccgtttaacatgagtgcataagagttaagaatttgtcggtctgttacagtaagttttaaaaaaggattatccataataaatacctctttcttcatagttcatatcatttgtgtttactggttcatacaatcatgcatgaactaaaatatattttatcataaagtaaagtttgatactaccttaatcattataagtaaaaaagaaataatgtgcaagaaaaaaatgaataaaagtttattgaatgaataaaattctattgactaaaatatattttattgctataatcaaattatcaaaaaataaaggagatggatgaaatgataaaacaaatttttacaaaaaatgctccggaggcaattggatgttattcacaggctgtacaatacgataaacttttgttcagttcaggacaaattcctgtaaatccggaaaatggggaaattgtttctggaggtattgttcctcaggcagaacaggttatggaaaatattggggctattttaaaagaggccggaacggactatcgttcggttttaaaaacaacatgtttcttgaatgacatgaatgattttgctgcttttaatgaggtatatgcaaaatatttcacagacaaaccggcaagatcttgtgtagcagtaaaaacacttccgaaaaatgtattatgtgaagtagaagtaattgcggtggtgaaatagagaaaaacaaatgaagattagctggaaaaaatgtatccagccatgaggaggatttatctatgggtaatcaaaaagtgagagaaaagaaaaaaccaacattttttctggcagtacttcctattttagcgatgattttactgctcggagttggttatgcagttatgggactgagtccagaggtactgatgctggtttcggcggcagtggcggcagtcattgctatcgcgttgggatatacatgggatgatatcatggattctattgttggtaaactttcaaaaacaatgccggcaatatttattttaatcattgttggttttttgattggttcgtggatgattggtggaacaatcccgatgatggtatattatggacttaaaattataagtccccggtacatagcggttacatcatttcttgttacagcggttgtatcagtttgtacaggcacatcgtggggttcagccggaacgataggagtagctttgatgggagtagcagcaggtatgggggctccacttccgatggtagcaggtgcagtggtatcaggagcatatttcggagataaaatgtctccgttgtcagatacaacgaatcttgcaccgattgcagcaggttcgaaattgtatgatcatatagggcatatgttttatacgacaattccgggatgtatcatttgtattattgtatatacaatagccggtttttcagcagcaggtggaggtactgtggcaacaccggaaaaagtagaaacaatattgacaacattagagagcctgtttcggtttaatccgcttgtaatattaccgccactcattgttttatatggttcaattcgaaagaaaccgacgatcccggtcatgttgatatcaagcgttgttgcgttttttaatgcgactgtttttcaaggattttccttacagcagtgttttacggcagcaatcagtggattcagtcttgacatggtaacaaagacagggtttgatgcagcagcattgataccagatattccaagacttttagagcgtggtggtatgctttccatgttaaacacggttttgattgcattctgtgcgtatggatttgcaggaacgctggcagtaacgggatcattagatattgttttaaacaagttgatgaaaacagtaaaaacgactggaggattgattgttgcaacgattgtttcatgtattacggctgtttttgtgacgagtaacggtcagttatccattttaataccgggagaaatgtttgcaaaaacctatatcaaaaagggattacagcctaagaatttatcaagaactctggaagattctgcaacagttgtagaaccgattgttccgtggacagcagcaggtgtttatatggcaacaacacttggagtgcctacattatcctatcttccttgggctgttatttgttacacaggtgttatatttgcgattatatggggatttacaggctttggtattgcaaagataaaacctggggatgagtattatgatgagtatctggcacttcagaaggaaaatgaaacagtataaccaatatgacgaggagattgtatatggaaacacagtatgattttgatgatatagtgaatcgtagaaacacaaattgtggcagatgggataccatggataaaaaatatgggacaagagatatgattcatttgggtgttgctgatatggattttcgggcatctgttgaaatcagagatagtctgcataaaattttggatatgggtgttttgggatataccgatttaagtgataaattttttctcagtattcaaagatggtataaaaaacaatacaatatggatatccctagagaatggatcgttttttgtccaagaatcaatattgcatccagtatatgtgtggaaacatatacagaaaaaggtgacggtattattatgcatacacctgcatatggtccattgcagaattcaattttaaaaaataacagaaaaatgctgtccagtccgcttaaaaaaaatggggaacattatgaaatggattttgcgcaaatggagtcaatggtggatgaacatactaaaatgatgatcttgtgcaatccgcataatccaacaggacgggcatggacgaaagaagaattggtgcaagttgcagacttctgtagagaacacgatctgattttatttacggatgagattcatggtgatctgatgaaagcgggagtgagacatcagacagcgttggatgttacagaagagatgaatgacagactgattttagcaagttcgccgacaaagacatttaacattcctggagttattgtttcctatatgataattccaaacgaaaaattaagaaaagagatagaggttactattgatcgtattgggatgcataatccgacaatttttgcagtaactgcggtagaaaaggcatatacagaatgtgatgactggtatgaggctgtcaaaaaatatatagatgcgaatgaagtgtttacaagagattttttcgcaaaacattttccagaatttcatgtttatccgagagaaggaacatatctgctctggatagattatcagaaaaccggactaaccgagcagaaattagaagagtggtttttgaaaaaagcaaatgtgtcagtttatatgggaagtgtatttggggaagatggaagaggatgtataaggctgaatctggcatcaccaaggaaggtattggatgaagcatataaccggatgttgaaagtctggaaagaatggtaaatgagaataaaaggctggtgttctatagatgagaatgccagctttttgcgtgcatctgggaatgtactgattttacgattagattatgagaggggagaaaactggtgtaaatacggtggggatatggtacaataaacgggtattgaaagattaagaacaaatatacaaccagatctagtacaggtcaggtctatacagaaaaataaggcagatattatctcccggaaaggagactggcagatgaatgatgcattgaaaattgaaaataatgatattatgaacaaatttcaaaaaacggaaaatattttaaatgatgttccaaatatcatagaagtttcacagaaagaagcctatcgtgcggttaatacaattttgtcacagagaaactggctgatcgggtatcggatcgcagaggaagaactgctcggtgaggatcgtgcagagtatggggtagagattatcaaaaaattgtcaaaagaacttacagataaatatggaaaaggttatgacagaagtaatctttatcattgtgtacgattttataaagcttttccagagattgtcgacacactgtgtcgacaatctaatattagactttcatggtctcattatagaactttattacaggtgcatgataagacagcgcgtgattggtatgaaaaagaagcatatgagcaaacatggagtgtgcgtactttacagcggaatatagatacacaatattattacagattactgcagtcgaaagataaagatgctgtagagcatgagatgcaggaaaagacgtttgagtatcagcaggacaagttagaatttataaaaaatccagttgtggtagaattcttaggattgacattggacgcttcttttaatgagacaaaattagaatcgagcattatctcaaatttgcagaaatttcttatggaaatgggaaaaggctatgcgtttgttgcaagacaacagcatattcacactgagaaacaggattattttatagatttggtgttctataattatattttaaaatgttttgtattgattgatctgaaaacaaccagaattacccatcaggatgtagggcagatggatatgtacattcgtatgtatgatgaattaaaaaagtcaccggatgacaaccctacgttaggcattgttttgtgttcggaaacagatgaggatattgcaaggtattctatactgcatggaaatgaacagctatttgccagcaaatataaattatatctgcctacggaagaagaactgcgtgaagaaatagaagcacaaaaggcggttttttatttacagcagaaagaaacggaaaagcaaaacaaggaggaaaatcctctgcttctgcaaggggcacatgctatgcaaaagcagcatagcagacattttgctccgcaaaacaaggagggaaatcctctgctcctgcaagggcagtcgcattttgctccgcaaaacaaggaggaaaatcctctgctcctgcatgggcagtcgcattttgctccgcaaaacaaggaggattaaaatgcttccacaagcgtttttaaacagaatggaatcaatgctcggaaatgaatatccggcatttttagaaagttatgacaaggataaatatcaggcattacggttaaatagtatcaagggagatactgcgcagatgaaggaaaaagtacctttttccctgcagccgatagcctgggcgaaagatggattttactatgaaaaagatgacactccgggcaagcatccgcttcatgaggcgggcgtgtattatatccaggagccgagtgccatggcgccggtttcctatctgatggaagattatgatgtggtgcaaaaagaagcggcagactgtcaggaacggatcttagatttgtgcgcggctcctggcggaaaaagcacacagatcgcggcaagaatgcatgaaatgtacacatcagggaagtggaaggagcagggacttctcatctgcaatgaaatccatccggcacgcgcgaagattttatctgagaacgtggagcggatggggattgcaaatgcaatggtgacgaacgagacgccacagcgtttagcggagatgttcgaggattattttacccgtattctggtggatgcgccgtgttccggggaaggcatgttccgcaaaaatgaggcggcatgtgaagagtggaaccctgagaatgtcagcctttgtgccgaaaggcaggatggaattttagattgtgcggcttcaatgcttgcaccgggcggcaggatcgtgtattcgacctgtacctttgcgcctgcggagaatgagggcagtatgacacgctttctgctgcgtcacccggagtttcatattgtggaagtgaaaaaggcagagggtatgtcggcaggagtaccggaatgggcttatttcggggaagaaaagggacaggtattgcctgagattgcacagacgatccgtctctggccacagcatctgaaaggagagggccactatctggctgtccttgaaaaagagggaacactaagacagggttattgccggaatggggaagaaaaaggaatccctgcaaaagatctgaaagtaccgggcaaaggaatcgtggaatttctggattttgcgaaagatacattagatccacagacattagccggactggagaaaaatggtacatatgtgaaatttggagatcagctttaccttgcaccgaaaggtatgccttctgtaaaaggtcttaaagtcctgcgaccgggactgcatcttggaacggtaaaaaagaaccgcatggagccgtcacatgcgcttgcactggcactaaaaaaagaacaggtacgctatacggcagatctggcttcggacggagaggtgatccgtggttatttaaatggcggaactttttcttatgagggagaaaagggatggtatctgatcatggcagacggatttagcaccggctggggaaaactggcgggtggaatcatgaaaaaccactatccgaaaggacttcgaaaaatgtggtagtgtgaaaatgagatttttgtcggggcagaatgccattgtgcagggtggaacgctgatcgtactgcttatggatcaaaaatcaatgaaatggcattatggcgagaaatattaaatgtaatcattacaattacatcggctttctgatatgattactgccagagagaggcgtttaagcagtttcaataaagaaaaaaataatgcagagatgtatattcatttacggatacacatctctgcattttgtttacgattatagctatgcctgcgcaggatacaatctatgattctgaactttgacttgcaattctaaaaagaatccactatcagattttacccatcaggcacgttccttcgcgcctgattttaccgtgaaaaatccaaactgtgccgcaatctttttcgcataggtcagcgcaaagaacaggataaaactgtcgatcggcagcatgatcacgtttttgatgacacgagggccaagcagtgcgataaagccttttccgtagagcatggagatccagagcgtattcagaccgcagttgatgaccagttttacgagaaactcagcgatcacgatacgtttgatggagaccggacggcggtagagcagggtgccgtagatcagaccggaaagcatggcattaaaggtgaatccaaagaaaaacggaccatccggttttaagacatactttaagaggtcgagtgcaccgccaaagagacatccgaccgccggaccgaataaaaattcaacgatgcggtttggcagcccggaaaagccgatcttgatgtaaggaccgagctggatgcttgcgaccatacttaagacgatggcgagtgcagctaagagtccgcagagcacgaccgtctttgtgtggcacagttcctgaagtgattgttgatacagttcctttaattttttcataaaaaaagcctccttccttagcagtttcctaaaaccacatagaggagacataaatacctttatgcagcagcgggatgcgaattctgtaccgcaaacaaaagcagcgcctttgtttttcgtccgtgtgacaactccctgttcacatggcacttaacgcacagagttctactctgctaatatgaaatattagttttgacaagttttgttatagcatactgataaggctttgtaaagaagaacttatattttgtgatgtatttttaaatatttctgataaaacagattcctgtaaaggctgatgacggatcaggatttcagtgttagaataaaaggtatcatgagcgtaagcaaacggcgaattggatcatgtgacgattttgcacatgatatgaatgaaagtaatgtgggaggaaacaccatgaagctgaccggtatccatatcaaaaattttaaagcgatccacgagatgaaaatcgacagcatcgaaaatgcattgattctggtaggacagaacaatacaggaaagacaacgatcttagaggcaatccgtgcagcttttggggattaccgcatctcttccgaagattttgacggtgactgtgccaacattgagatggatctgtcattagaattttccattgaagatttaaaatggctgcatcagaacggggtggtcagccagtataaaagatatgagacgtggcttgaggatttctgcaaaaagctgccgtcattttctctgaacgaggaagcgacaggcagcgtactgcagtttacgtttatcgcacacagggatggctgggtgcgttatcaagataaggaacataagaataattcctgcatcccgcaggtgttcccgaagatctattatctggatgcggagcgtgatctaaaccagctgcagggagatcttttaatgctgcaggaggatgaactgttaaaacggatgcgagcggacacctgtatgtttaatcaggcgaaaaaatgtgggcactgtttttcatgtatcggtctgatcgagaagaaaacaccggcagaactggatgcatttgagacggcgaaacttttggattacaaactataccagttaaatctggatgaatttgcaagaaaagtaaatcagaattataaaaagaacggcggacaggatgagattttatattcgatgaaccgggatgtggagcggatgttaaaagttacgaccgagatccacaatccggcgcagaacctgaccagaccggtggcaaagatgggaaaaggcatgcgcagtatttacatgttgtcgctgcttgaaacatatacgggaacggaaagtcggatcccgagcattcttatgatcgaggatccggagatatttctgcatccgaaattacagaaagtttccggggagattttataccgcctgtccagaaagaaccaggtgatcttttccacgcactcgccaaatctattggcgaactttaacagcaggcagatcagacagattgttttagacggcgaaggatattcgaagatgtgtgaaaagacggatgtgagtgcgatccttgaagatctcggttacacagcaagtgatctgatgaatgtgaactttgtatttattgtggaggggaaacaggacaagagccgcctgccgcttctgatccggaaatattattcggagacttacgatgagagtggaaaactctcaagaattgcgatcatcacgacaaacagctgtaccaacatcaagacttacgcaaacctgaaatatatgaaccagatctacctgcgggatcagtttctgatgatacgcgacggggatggaaaagaccgtatggaattagggcggcagctctgccgttactatgagcagcggaatttggaggatgttgacactctgccaaaggtccggccggaaaatgtcctgattttaaaatactactcatttgaaaactattttttcaaccccaaagtgatgaccgaacttggtgtggtcgaatctgaggagacattttatgagacgctgtttgaaaaatggaaggagtatttacaccgtcttagcagcgggaaacatctgacggaggtgcttggatttgagatgcagagcatttctgatatcaaagcacatatggaagaaataaaaatctatttgcgtggacacaatctgtatgatattttttatggaagatacaaagatcaggaagaggaactcttaaaacgctatatcgatcttgcaccgcgggaagatttttccgatattttagatgcaatcgatcattttatttattttgagagcagaaaacgagaaagggatacaaagtgaaatgaaacgaaatggtgcaaatctgacagaaggaaagccggtcaaactgatcctgcagtttgcaatcccggtatttttgggaaatctgttccagcttttttatgggctgattgacacaaagattgtaggcagtacccttggtgagggagcgcttgcggcagtcggttccgtctcgatcctttataatctgctgacgggattttttaacggtttaacgcttggtttttcggtcgtgacggcaagatattttggggcaggggacacggaaaaattaaaaaagagtgttgcgggaacgattcttttaggatttgtgacggcggcgatactggtgaccggcgtatttgtatttttacgtccactccttagcatcatgcatgtgccggcagaacagaaagagatggcatatacctatatcagcatcctggtgcttgggatgtttgtgacacttgcatataatatgtgtgcaaatgtattgcgtgcgatcggagattccatgacaccgcttatttttctgatccttgcggcggtgttaaatgtcattctggactatgtctgtattctggtattttccatgggtgttggcggagccgcagcggcaactgtgatctcacaggtggtatccgtggtgctctgtgtgatccatatcaaaagacatttcccgatccttcaggtggaacgcagacattttaaactggaaaaatcagaagtgcgtacgatgttgtccggcggactttccatgggaatgatgtcgagtcttgtaaatcttggtacactgatcttacagaccggaatcaatacacttggaacttccgtgatcgtggcacatactgcagcacgaaaggtttttgaaatatggggactgccggtcacggtgctgggagcgaccatggcaacctacagcggacagaattatggcgctggtaaatatgacaggattacttccggcttaaaggcggcgctgatgcttggctgtggctgggcggtgatggtcatgatcatggcatatacgatttctacctgtctggttggctttatagcgagtacgcaaaatgcagaaattctatactggggaacaacgtatctgcgggttgatatgttgtttgagatggtctgtgtgtggatcgtgatcctgcgcaatacgatgcagggagtcggagattataagacaccgatcttttccagctttctggaactggcatgtaagatcgtgttcacggcggtattcgtccggtatttcggttactggggcgtcatctggacagagccggttacatggatcattatggtgataccgttaattgtcatgctgaaaaaaaatcctgtatttcaccaaaagaagacagcttagaaaacatcagtagaatcgaaaaaacagcaattcgcatgggaatatatctcagcagcaagttgctcagaaacgaggaatattatgaaaaaacaagtgaactatatagagattgcgaaagaaaccgtgatactgacggcagcggtggcagtcattgcggctgcagtgtatttctttttggtgccaagccatgcgtcagtcagcagtatttccggtcttggaatcgtgctttctaattttattccactgccgttatcggcaatcaccatgattttaaatgtggtgcttctggtcatcggattttttacctgtggaagggaatttggggtaaagaccgtttataccagcattatgctccccgtgtttttagggatatttgaaatggttttcccggatattggatcactgacggacagccaggagttagatgtgctgtgttatattttagtggtcagtgtgggactcagtattttatttaaccgcaatgcatcctccggcggacttgatatcgttgcgaagatcatgaataaatatctgcatatggatcttgggcgtgcaatgtccttatcggggatgtgtgttgcactttcagcagctttcgtttatgataaaaaaacagtggtactcagtattttgggaacctattttaatgggatcgttttagatcattttatttttgatcataatatcaaacgccgtgtgtgtatcattacggaaaaagaggaggaactccgcaattttatcctcaatgatcttcatagcggggcgacgatctatgaatccatcggtgcttataatatgcagaaacgcaatgaaatcattactatcgtggacaagaacgagtatcagaaattgatgaattatatgaatcatgaagatccgaaagcatttattacagtgtattatgtgtcggatatcaggtatcagccgaaagggtaaggtgcagtcagtggaaaaatggagtatgaccatacacaggttattcagtaaagatccaaacgatgaagaggagaacgtgacgcaaaatatttatgtattccggtttatactgttttgcattatcgtttactcatttgagatgctgttaaacagtgttgatatttttatcgttgacaagacgatttttacaagagggtatgttacaggatgtctgtttgcagctgtatatgttttgattttactgcatcttggactggagcatccgctgacgaagtatgtcagtattacggcggtcagccttatcatcatggctgcgagtgtgtccttaacctatcatatgatcattattattatgatgccgatcatcatagccggtatgtacacgtcaaagcaactgtccatatatacgtttgtacttacagtgctttccattattatcagtacctatgcaggatattattatggtgtgtgcgatgccaatatggtgcttctgacaactacttctatgaatcatctggttgaaaatggaatttttttactgaatcaggtaaatgaaaatccgggagtcacgcttgcactgtattatgtgctgccgcgctgtctgatggcaatgtcgtttgtctatgtatccaacattgtaaatcaggtaatccgaaaatcactgaaaaatgcgatgaagatggaagagaaggcagcgacggatgagatgacagggctatacaataaaaacaagctgcttgcgaccattgagaaaagaacatatgattaccagcaggttgccatcgtttaatgggacattaaccgtttgaaatatgtaaacgatacatacggacattttgccggagatcagatgatcgtaaaagtggcacagtcaatacggattgctttaggagatgcagggatggcattccggtatggtggagatgaaatgcttgcgctcattccgggaggaaccggcgaaactgcggaaaagatgataaaaacctggaaacagacacttgcagcggtacaggtggactgtgagataccgatctcagcggcggttggatatgccatcggcgagcatgaaaagttaaaaaatgtgattgcagaggcggacagaaatatgtatgcatgcaaacatgcaggcagaaattcaactgaaaaataaaaatttaaaaaaattcttgacttgaagtccacttcatggactatactcttcgaaaaaaggaggtaatgttcatgatgacagaaaaaatgataacattaaataatggtgtggaaatcccacagcttgcacttggaacatggattgttgatgataacaaggttgcggaaccggtgaagacagcgatccgtttaggataccgtcatgtcgacacggcacaggcatatgcaaatgaagtgatatgttgtattaagaaggtgatactcttttaatcgaaactgtaaacatttagcacaaaggaaggagcagcgtatggagttaacatatcattgggaaggcgatgtattgattccagatttggaattggaagatggaaacaattatcagattggcaaatatggcagaatgtgacagaggtatttgtttgaaaatcatcatgccatgtatacacatctggttcttacggaaaaattgtggaaacatttggaagaagtagatatggaatgcaatgacatgatggatatgcttacggtaagaatggctgagcgtgaaggtgtgacggagcacttgaagtcagttgaccagctcggatgggtacggaaaatgaatagtatccggagcagagctgaggaagtagtgttgcatgatctgatttatatggattaaaaatagcgggaaatcttaattggtttcccgctgtttggcatatgaaaaagttcatagaaaattcagttgattccgtaaagttcctcgcttataatgatattgaggcagagagccttttgcggaatcttagaagtgttatgcacaatacaaaaggagggatgccgacttgaatacagaaatagcaaatgctgtgaatgtagcaggagataaggcacaatatgatactcgtgttaaaaggttactggcacagaagagtatattagcacatattctggtgaaaacagtcgatgaatttaaaggaatgaagccggaagatgttgtaaaatatatcgaaggcgaaccgagtattagcgttgttccggttgagccgggattagcaaatatggaaaaaacagatgctacaggacagcgtattgtaggtcttaatacagaaaatgctgaaattaatgaaggattagtcagatttgatattattttttatgtccgcatgccatccatagttggcaggaaaaatggactttcgcagattattgtgaatattgaggctcagaaggatgagccaacggaatataaaattttaaattgggcaatcttttatgtgagcaggctgatttcgtcacaaaaggaaagagattttgtaaatactaactacgatgacattaagcaggtattcagcatatggatatgtatgaacatggatgataacagcctaagccatatccatttgacaaaagatgagatgttaaaaccatgtaactggaaaggtaatctcgatctgttaaacattgtgttaataggaatcacaaatgagattccggaacatgatgaaaaatatgaaatgcaccgcctgattggggctttgctttcgagtgaactgaaagaacaggaaaaattggatattatagaacatgaatataatattccaatcagtcaagaatttagagaggatgtgagcattatgtgtaatctgagtcagggtattgaagataaagcaattgctaaaattgtgatgaatatgtataaaataggttatacaccaaatcagatagcagatgctgttggtgtgagtgttgatgaagttgaggcgattattaagaaaaaagagcctgcaatggcgtaagctttattaacccaaaagatctaaaaataagacggcaaatcgtcaacaagttgttgatgatttgccgtctttgttttgtatataggagttattcctcttttttcttagcccttgttctatagacattatactgattcttgcatttcggagagcagaactcatttcccttacggcttgcgataaatgccctgccacagtgcttacacagcttcatatcgcagtcagaatccgtaagcataaaagagaagcacatctggatcatgacgagcagggaatggaagttccatacgataaccggggtatttttcgctaatgcgatatggtaagtcggggatatgccgccaaatgcagacataccctgacgatacaggttttttgtctgttcatcaagactgtcgtagtccatataatataagaaacttgtggtaaaggtaaatgcccaatttgcgaattcttcctcggttcgtgcactttcttcaagacggctgattgccaatgcacgggcttccctgtgcagcatagttttctcactggaagaatcgttgtattccggtattaagttttgtttgcggaaagcttttagttcctcatattttggcaatttaatcagtccttaaaaatttttttcaaaaataatttcaaaacacttccgattttgtagccgtatttctcctattagtgaagagagtaattctttttatcactaaagcaattacagaaaggagcaaaaaggctatgaagtatggataaacaaaagcttcggttacacgaagcggaagcatgaaacaattataatttttatcagagagaaaggcaaggattgattatggaggcagaaaaactaaataatggcgatagaaagtccggctcatgtgaagctggatttttttatcgcaggattggtgggacagtttacaaaatcagggtattaacgagtgaaaacagtacagataccttttcggacaagatttcccacattatttcaagagaggtgctgacagagaaagcggattatgataagatagagctaccacaaataagtcagttgccggaagggagttcggcatgaacagaaccagacagacaactgacaaatcgaaaaacagaataactgctctttatgagcgactctcaagggacgatgagcttgcgggagacagcaacagtatagtgaaccagaagaaaatgctggaggactatgcaaagtgtaatggatataccgatttggtgcattttacagatgacggatattccggtgggaattttgacagaccgggatggaaagaaatgctccggcagattgaggacggaagcattggcgcagtcattgtaaaggatatgagccgagtcggcagggattacctacaggtaggattttacacggaggtattctttcgggaaaaaggtgtccatttcgttgctatctctaatggtgttgacagtgatatcaacaccagcagcgaattcgtcccttttttaaatatcatgaacgaatggtatctgcgtgactgcagccgcaagataaaggcggtattgcaggcaaagggcagggacgggaaaccaattaccaacaatccgccatacggatatatcaaagatccggaagataagaaccggtgtgatatgtcaaagccatatgaatgggcaggagtaagtgtcgtaagaatgcttgaaaaaccggagtatatgggagatactgtgaatttccgtacaaagaagctttcctataaggataagactgctgtaaagaatgacagtgacgagatagtggtctttacggatacccatgaggcgatcattgacagaaaaacatggtatatggtgcaggagcttagaaaaaccaaacgcaggataaaaacagaaggcgagtcaaatccgtttgtgggtaagattttctgtgcggactgcggtggaaagatgcattatcgtaatgagggaaagcgtgccggaagaaaatggagaggactgccggatggcagtgtcagaacaactccagcctgttataactgcggcaattataataacagccatgaccagtcagaaaaggtctgctgttcgcacaatatacaggcaaaggtggttgaccagcttgtgctggaaaccattcagtatgcgtgtaaaagtgtaaggatggatgagagagcatttgtcgaaagtatccgcagtgcatcagaaatccgggaacagagtgaggcgaagaagctgaaggctgcgttaaagcatcaggagaagcggtatgcagagcttgatatccttcttaaaaaagtgtatgaggacaatgcccttggcagactgcctgacaaaagatatgaaatgctatcggcagggtatgaaaaagaacaggcagaactggaacagtccattaaggcatgcagggagcagcttacgcagtatgacgaggatacagaccggacggaggaatttctggcattagtccataaatacacggatatcacggaattaacacctgtcatcatcaatgaatttgtggataagatacttgtccacaaagcggaaaagattgatggcgagcgtgtgatggagatagagatttaccttaacttcatcggtaaagtggaacttccggcacaggaactgacggaagaagaactggctgaaataaaggaaaaacaaagacttcgtgagcgcaatgccatgtaccagagacggcgcagggcaaagttcatgccaaaaacaaaagcaatccgtgcgaaggtgcaggaggctgagataaaagaaactttggagaatgcgagtgcaaaagcggaaaactgcttatggcagataatgatgcacatatcgcagaggttgttgcaggggaaaacaaagtatatgttgataccgggattttcccaacagcagaacgaaggcatatggcagacagggtacaaggaaacgaggcagagagggaaggtaaaaataattttgatgaccataccatatcggcaattataaaaagcgccgatatggtataatagaaaaacaaaagttattacagggaggagaatggattgttagaagtagcaatatgcgatgatgataaggaagatcttgacaaagcggcgctgatgctggataaaattctttcagaatatcaggttcaatatcagattcggtcatttctatcggcgaatgagctgctgaacaataatgacaagattgatatcggaatactggatatttccatggaagaactgggcggaattacgctcggaagaaagctgaaagaaaaaaatcatgatataaaaattatatacattaccagttatgaagaatacatggcacaggcgattaataaggtacatgcgttttcttttttgtgtaaaccgatcaatgaagaagaaatgaaaacgcagattatggaaattctggggaaggagaaatgtccggaaatagaaaaggaatttgaaatactagatgaatcaggaacaaaagcaggttgtgtgcgtttgaaattaaacgagatattatattttgagtacataaaaagatccagaaaagcagcaattattctggaagattgcagatatgaatgtgaatgtacatttgaaaaccttgtggaagaattacaaccatatgattttgcggtaaatcacagaggctgtcttgtaaatctgagacatattgagaagatacagggatttcatatttatctggacaatgggaaagaactgtcccttgcgcaaaaaagaagctctgatttccgggaagaaatgaataaatttttgcagaaaacccagaggagagaatagaagatggataagattttacttgcgatatgtaatggactttcctgttttattatctgtacaattctttttcaatttatgaatgaaagatataagaaaagttacagcaataaaactttgtacatagcggcagagatagcgatgggaatcactgcatttggcataaatatgctgaactttgcaatattgaatctgctgatatggtttgttggagttggtgtaacggtatattttctgtattacgaagatgcagacagaccaatccgtagaatcactgagtgtgaagtactggttttatgtatgtctgtatgtgaaacgctgggagtgcttctgttacactgttttttgcagatttgtggaatatcaaatattgatgttgtcatgcaatattgtctggaagtgacattttcaaaactaataatgatattcctatactatgttttgataaacagattgataaaaaggacagaagcagcctgttccagagaacaatatatcatatatggaatcctgtttttttacagtctggtcaatatgcttgtgattgtgcagaatttcagggatgggcagaaaagctatctgtcagcggtaaatatgggctgcatcgttttggctgacctgtatcttttgtattatgtcaaaatggcagacgaaaagagatactatgaaaaccgcgtaaaggcattggagcaacaggcaaaaatgcagtatgagtattatcttgcacagactgaaaaatatagtcagacagtacggatattacatgatgtggataagcatatcagggctatcgagaatttgtatggaacagagagggagcatacggctggcgaatatgcagaggcaatcagaagtacactggcaccactgattcctatatcttacacagagaatccgatattgaacattttgctgacagataaaaatgctgtcatgcaggagaaagggatacattcggacattaagatagacaatgtagacttatcttacatagagccgatagacataacaactattttcgggaatctgctggacaatgcgattgaagctgccgcaaatgctgacggagacaaatacatttttattaaaatcagtgcctatcataagatgacggtagttcatatagaaaacagttgtggaaaggtaaaatggaaaaaacgtatgccggtatcagataagggaaaaggcagagggataggactcttaaatgtgaaacagagcatagataagtatgatggggatttacaattaaaacaggatggaaacagatttgtagcagatttgtttctgaattcatgaaaagggcgttttcgtcctttttttgtgctcaaatcgtagttggtgcaaaaaaatcgtagttggtgcagagcgtataaaatatgtgaagaatagtgccgatgaaattataaaagaatggaacatgatataagtcatattaaggatataggtgatattatgaatattttttttaacagccgaatttataccaatcagtcattcgttaatgcgctgtttggaaaacaacaaaagactacaagaagtcaagatgctggttgcaacggtacaagagatactttaacgataagcgcatcaggaaaggaaaagcttgtaaaaaatacgaaaggaagaacacataatacaaatgttgacaaaagtattgatttgaaatcctatatagcttcagcccaaaaaacaaatcaaaaaataattgataatgcagggacacagattaatgcgaaaacaagtgaatatatgagtacaggtaaggcttttaggggagacagttatgaagatttataataatatgaatattacatattctgcaatcgaacaaaacagcagaaaaaatacaaagcaaaatattccggcagatttagaaaagaaaatgacacagtacacagatacactttctatttcaaagacagggcaggaaatctttaagcatttatcatcagttagttttatggattatgtcaatcggtttgaaaatgaagtaacagaggtatttgcaaaggaagatacgacacagggggtgaagtcagatacttttgaacatcatgtaaacagaatggcaacagcatataacaaaatgaaaaacagcattgaagaaaaatatgcggcacaagattatgagcaagagtattatgtgacggaatcgggcaaaattgaggaattaaccaaagaaaaagaactggatatgctaaatcaggcatatgaaaatcacagtaattttatggctacttccacagaaatctggtcagaattacaggattttacaccatcggtagtttaccataaaggaagtgaacagacagcaaatgaacagaacataggtgagaaccaggagaatactgcaagatctaaagaaaatggggttatccaaaattcggcatatcaggcatttttatccgccatccagtcggataaccagaaattatcgcagcagtattcgggtgattggaaagatttaaggctaaatctgaatgtatcagatggtgatcggaaaatgcttaatggtatttgggattattatgctatggagagtgaatagattccgaatgacagaggaatgaaaataattggaggaaacgaaaatgagtatagcaggaattaacggttataattattcaaattattatacaggaacaaaaagaaacactgcgaaagcaaacggtatgaattccggtttgttatcaaatgtaagtagtacatcttctaatattacattacatatgtcgggaacagaagatagtggaaatgcattaacagcagtaggatttccggatggcagtagtgcatctgtatataaatcagatgcatatgattcggcaaacccagaatacagggtaagatattgggacaaagaaggaaattacacagatacaaatgtacagataaatgatgttgatccaagaaatgcaagttatttggaaatgcttgcatatacaacatatagtgatgtagaaggctttacgaaaaatgcttttggagatttcatgaatgcggctggtggtgtgaatggcaacatcacttatgattctgacagcataaatgaaaagaaagactatatgagcatgattgaagaatttatgcagttacaatatgattcgaacaacttatcaggttatctgtcatataaggaattgtatgattacataaatgacagaacagagaggtgattcaattaaatggaaatatcaaataattatagcacagcaaaagtgtggaacacatcgaataaaaatgtttctaaatcttctgaaaaaaacaaatggaaattaacggattctttaaaagagaagattgttgatctggcaaaaaaagatgcacaggacaatgtatatatgggaaatgcatttatgaatttgagaaagacggaagtaagcaaagtagccccgaatagagctgctttaattggaaagtttagtcaatcaatgaattcaggtaatatgtcagcaatgaaagaagttgaggaagcagacaaaaaatggctctgtatgctgtttggaataccttatgaggcaaaatatcagggaacagggacaggctcggcaattcatgtatacaatgaagatggcgaagaagttttgacctatacagggggagtaggctggcaggaaaaagaaacaaaagcagagtcacaggttcattcagcattaaaaatgatatattatgaggcatttagtgaggcgagaaaagcattaaatagtgaagaaaaggctggcagtataaacaaagacataatatcacaaggcaatttcgatatgaaagcgtaaaatgtgtgatttaataatgtgtcttatatgggaatgagcaatgtatggcaatgttcagggaacaaaaaatctaatgagtcattatgaaggtgacggtgattatgttaattataaagtgtcacgtgattaataaggaggacttgcactatgcagattaatgctaattattctgtgaatggcgtgccgtatgataataaacgtaagcagaataatatccctcaatttagtacggaatgtgcggttcaggaaaatgaaaatataaatccatatatggcagaaccactggtatatgtatgtgactgttatcaaaaatttaatgtagtgacagggatgcccaagagtaacttcggagattcttttggctatgatatgcagaaagatatatccagtcatatgaccgatttttatgccggaaaggtgagcagggatgaacttaattcctattttgaggaatgttgtacttccatgcgtacctatcggacaagtcagcatcagacatccggaaccaatgaagcagataatacacaaatcgtaagtgagatgtatgaggtatttgcaaaagaaaatgcaagggcagcaagtcaggcaaactatcaggaaggaaaagcattgaatgagaaatactattctgatagtcacagtgactggacttattataattcagattattactatcaatgcaatgaaaccaatgcggcattgagggaatctgtcaagcaaatgaccgaaaaatgggatttggatgagattgactgtgataaaatcgaagcaaattccagtcttacattagatggtggttttgattttaacagcacatggaattttgagtttagaaatcaggctggcaggagtagtctggcaaaggaatcagcgataccgcctgagaattttaagatgtttttcaaggaacaggtaacatcttttacagaggacaataaatttaatggaaatctgaaaataacaatcggagagaataattacgatttaaaggttccatttcagacgttacgcaccggatcggaaggggaaatttgtaatgtctgggatttgatggaagattattatccgaagtcagaagatacctctaaagttaaaaatttcctggggaatatgtctgtatttacacggtggtatgcatatgaaacaagaattaatgacatatttggtgattatgaagtgtcacataaggagttgagttaatgggtatatcattgtcaggtataggaactgttggaaaagagcaattaatttcctcatgcagtaacggagaaccgaattggctttatattccaacaaaagggaaaagttcaaaaacgcatgcggaatttgttagtgaaattaaagaactggcacgacgagcagctacgacagcaaataagacagagtacgaatatatttccagacaggttcttggtttacgggcagaatatctatcagatgttgcacctgatagaaaacaattatatgaacaggctaaaaatactataaaaaaacaaactggcaatccgaaatgcaaaggatgtggagaattatcattattggattttttggagaaggcagaaggaaaaagcagtaattttgctgaaaagaagtttgcactggcggtaggaggaacattgaattgtccaattctaactactggtggttatggtgctgaaattcagtatcagggagtaacggtattatctaatctcggaaatggctggggctatgagatgacaccagcggaacttgcaaaaaaagatgaattttattctatttattggagcgaatataatttcgtaaaagagaatggaagttcagaattgagagagatgccggattatttggatcaggatagaccttcttttgaagccagagcataaaataaatattgtacgcaagaaaaaatgagcataggagtagtgccaggtggcacttttgattttttaagtgaagtccagaactttatgataagattcataatcgaaacaattatgccgatatatagaaaagaacaggtaaacagatttacgatgtgatatgtacaaggaggacaacggatatgtcaatgaatgtaagcacaaccacggctgcttatgcaaattaccagaacaactacaagactggtacagcaaataagaaaaaagaaacagcacaaacaacagaaaatacgaaattaaaggaaaatacaactgaaagcatcgctgaaaaaaatctcagtaaagcggcacaaaaaatgctggagaatttgcgtggatcaagaaacgacatggattttatggttgccgattttgaaaatggtgataatgccaaagatattttagcccaaagtgataaggagtatacggttattttctcaaaggaagaaatggagaagatggcgtctgatccgaaatattatgcagaaaaaatgcatagcattgagggagctttgcgtatgtcagatgaaatcaatgcccagttcggatttgaaagaacattcggtaagactaacggcaatgcagatgctgatacaaaaataacaaaatttggcatctcttttaatagtgacggaactacaaccttctttgcacaattggaaaaatcatcagccagtcagaaagaatatcttgaaaagattcaggaaaagaaagctgctgagaagaaagaggcaaagaaaaaggaacagtcaaagcaaaccgaagtaagaaaaactatggttcaggcaaattcaaaagaagaacttttggataagatcaaaaacattgactgggattctatcaaaccggaggagaataaaatcggtggaaggtttgatttttcaatctagtgaatttggaacagatgaaatatatgccaatatggaggaatatattatgcagataacaagagataattattcgcaatatgctcaaatggttcagcagatgttcagaaaaaaagcaagttcaaatgatccgttagcacaatgtgattatggtaatttctcattaagatttaagcctgtggacattaattttaccaaaccaaactgggatactatcatgacaaaacgagataaaccagcgatgtcagaggaagaatttgacgaagcaataaaagaacttgcaagaaaagagtttgctactggaaaaagggatgatgatgcttatcgaaaattgtgtatgcagcatggagaaacagtatctcctgatagaaaggctatatatgaatcaagcatgaaaaaaactggtggcaaaatgaatgctgcatgtatgttttgggattcaaaaggtaataaaacgctttcttataatccagagtcaagaaactggaaagctataagtacagatgaagaatttgcaagagcaagagtgtttacatcaatttataatgatgagttagcccgtttgaaggaagagtatggcgaaaaagcgaaaggaaatgtttcttatagcaaaataaaggcagatatatccgcagaggaatcaaaggaaaagaacaataatgaaggaaatactattgatttgcagatttagattgttgattgcgttttagtaaatagtagataaaaaacggaaagatattcatcgctggtagcggcattgagttcataaattactactactctagataaaagtagtattccgataagttaaaagataaagcagatgcaaatagacacgaatcccagcgtataccaatgaaggagtttatttcatttctttaatagtgcagacatgactaaaagacagggcagtaaaccgataatggtttgctgccccttttcacaacaaaaaaaggtcatttcacaacaactgtggcacatacaatctgttcgtccgatataataaatatatttatcagacaaaaaggaagtgacaacatgcgaattgctatctgcgatgatgaagtatctatggttcagatactggaggaaaaaataaaaaagctattgccggatgcggttatagagaaatatctatcgggcgaagaactaattgcaagtggcagtaagccggatctgctttttctggatattcagatgccgggaatggatgggatggaaacggcaaagatgcttcgtcaggacaatgagaatatgatactcatttttgtgacagcagcagaggagtatgtttttcaggcatttgatgtcggagcatttcattatctggttaagccattttccgatgagaaattgaaagaggttgtgacaaaggcagtccataacataaaaaggagttccagacttgaaaaagacgaaaagtatattatggtacagaccgccggaagtcatataaaaattttcctgcgtgatattgtgtatgccgaggtgtataaccggaaagttattatccatacacgaagtacggatattgaatactatggtaaattacaggaattaagtgatatggcaggaacagattttttccgaacacacagagcctatcttgtacattttaaatatgtagaaaaatatgatgcaacttgtgtaactatgaaaaatggaactgcattgattgcaaaaaagaattatccggagtttgtgaggaggtatctgaagtataaccagaggaaaggaaatgaagtcagatgagtttagtggaaagatgttggatgatcacatcgaagttttctgttattgcaattttgattattacaggaatctgttttggtgtttttgtatatccatatatgaaaaagaaaagggaagctgctctggtcagtattgtttatattggaattatgtctgtgctgtatctgataccgcagcagattggcaatttttctgcatatatgctgggggttgtggctgcatttcttgtgatgtatgtacaggacagaagaaacatctatcagaaaatatttcttgcagtgacatttttttctatccgttggcttgcggttgcaatggcagacagactggatgattttatcacaaaagctctggtttttgggaatacgattgcaggaagacaatggctgcaatatggactttatgctggaacgagaattctggatattgtgctttgtatcgttttccttgcagttgcaatcggtctgatcaataaagcatatgtatacaaaaatgatgaaatgaacgttaaagagctggtaatgcttatcattccttctcttgtgggagttacaggatatggcattctgcaatattatctgaatatttatgaaaaagatacaggaaagagcctgacagatacctatggattttatggagctttaagcttcgtgcattattttatctctatcatagcaattcttgttatgactacgatgtttcaaaactggaaggtggcacaggaagaacagacagggcaggagctggtattaaatcaggtcagtgatatgaaaaagcatatcggggaagtggaaaagctgtatcaggatatccgcagcctgcgtcatgacatggggaatcatatacagatgctggaacatcttgtggcagagaatcatatggatgatgcagcagaatatatggagcatttgaaaaaggagtggaatgaaatatctcctgagattaaaacggggagtcctgtcattgatgtgattctgatggaaaagttaagagaagcaaaggaaaagcagattcgttttatatcagattttcattatccgggggatacgaaattaaatgcatttgatttaagcgtgatcttaaacaatgcactggataattgcatggaaaatgtaagtggagaaaatccttatatcagtatctcttcttttcggaaaaacagtatttttatgataaccataaagaacagatatgagggagagttaaattataaggacagtgatctgccagaaacaacgaaattcgggaaggagcatggaattggactgcataatatccggagggttgcaaggatgtatatgggagatatatctttagaacaggagaatcaggaagtggttctaagtattatgttacaggtagaataaggacaaaaagcaccttcgaggtgttttttatttgctttacaacaaaaaaagggcggttcacaacatcgctgtttattgtaaagaaagatatgccgaaagaatcagtaaagagaaatcatgttgtacagatttttaaggaaacggatttcagaatttaagctcaaggaggccaaatcctctcctcgccatggggctcggattttgcttcgcaaaacaaggaggattaaaatgagaatcaatggatttagtgggacaaatacgcagacaggaacaatgggaatgacacaggggaatgattctgtaagtaaaaatattcagaatcagattgcaaatgcacagcagaagctacaggatttatcttcgaatgaagaaatgtcattagaggataagatgaaaaagcgtcaggagatacagcaggagattaacaatctcaatcagcagttaagacagcaccagatcgagcagagaaataagcagcagagtaaaaattcgtcatctatggatgatatggtggctggaacaagtaacacttctaaaaagaaagacactggattgtcacaggcaagtatgcaggcgatgatctgtgcagattcttccatgaaacaggcaaaggtgcagggaagtatggcaacacagatacagggacgtgccagtgtgcttgaatctgaaatcaaacaggatgccggaaaaggaaatactgagaagaaggaagaagaactggcagagctgcaggcaaaggcacagtctgcgacagcagcacagatgtctacacttgcagatgcaaataaatcagtagaagaagctgcaaaagcggataacagcaatacagaagacactgcaacaaagaacaatactgataaatccgagaaaacacaggaatctgcgggggctgcggcagaggagacagacagcgtaaagaatacggatatcaaaggggaaacacaggtgacagtagaaacaccgactctggaaaatgcacagaatgcaacacagcaggcagtgtatacaccgattgatattcgtttatagttggtaaaggagaatggtattatgtcagagattaagagttttagtgattacacaagtaaatataacagcaatgtagattattccgcattatttggaggaacttccgacagttcatccgtaggaaacaccaatatgctttctgattatgctgcgattaaaaacggaagctatggaaaacttatgaaagcatattatgcaaagcaggatgcagaaaaattatcggggaaaggcgatacttcacagaagcttacactgatgaaaacaagtgcggattccctgaaaaaatcagcagatgcactaaacgatgcgtcactctgggaaaaaaagaaaataaaaaagaaggatgaaaagaccggggaagaaacagaggtagaggattatgactgggatgcaattaccaaaaaagtgaaatcttttattgatgattataatgatgttgttaaggaggcaggagaatccaatacaaaagatgtccttagaaatgcttcatggatgacaggcatgacagacaaaaccagtcatttactttctaaaataggtattaccataggaaagggtaacaagctggagctggatgaagatgaattgaagaaagcagatatcagttcattgaaaacggtttttacaggttacaattcctttgcaggcaaaacagcccagaaagcagctggtatatcaaatgctgcgaaccgcgcaagtgcgacttatacaaacaatggtacatattcgaaaaaggattcctctctaacgtcaagtaagatagataaggaagtatagtatgttaagcctaaatgacaagaagaaaaatcttttgtattaatttgtcgggaaggaggaaccagatgagttttacagtcaatttatccggtggaggtttactgataaatagatttaatagttctaatatgttgaaaagtacacaggaaaaattgcagcgacagcaggaacgggataataaggtggctttttttgaagcacaaaaagaaaatttgaaaaaccgaaaggctgacagtttggaagaaatctctgaaaagctggaaatgtttcataattatgaggatgaaattgcggcagcaaatcaggagtataataattcacagatgtttcatgtcatggacgaggcagaagaacatggcgaaaagattgcggaagctgctgagaggaataagcctaaaacagaagaagaacgaaaggaagaaatggtggatgaagctcttggaacagaggaaaacaagggcatgatgtctgaaatcatggacgaactttcggagacaaccgaagaaatgacagagcagatgacggaaaaaactgtggagaatatggaagaacttccagacgaggttttgcaggagcagcttgctacagatagtttaggggcagcagaaatggtacaaacagacacaattaaaaggtatgtgccgattgatattagagtctgatggtatttatctgggaaggaaacagctatgaagatttacaataatacaaatattacatattctgcaatcgaacataacagcaggaaaaatacaaagcaaaatgttccggcagatttagaaaagaaaatgacacagtatacagatacactttccatttccaaaacagggcaggagagctttcgacatttatcttctgtcagttctatggattatcagaaccgttttgagaaggaagtgacggatatatttgtcaaagaagatacagagagtgtaaaaactgattcctttgaacatcatgtaaacagaatggcagaagcatataacaaaatgaaaaacagcattgaagaaaaatatgcggaacaagattatgagccggagtattatgtgacagaatcgggcaaaattgaggaattaaccaaagaaaaagaaatggatatgctgaatcaggcatatgaaaatcacagtaattttatggcaacttcaacagaaatctggtcagaattacaggattttaccccatcggtagtttaccataaaggaagtgaacagacagcaaatgaacagaacataggtgagaaccaggagaatactgctaaatctaaagaaaagggggttatccaaaattcggcatatcaggcatttttatccgccatccagtcggataaccagaaattatcgcagcagtattcgggtgactggaaagatttaaggctaagtctgaatgtatcagatggtgatcggaaaatgcttaatggtatttgggattattatgctaataaaaggtaatgaaagctttgtaatacgaaaggagatgttagtatggcagttacaggtgtaaacaattactctaatatttacacaaatgcttataccggtaatatacagaaaaataatgctaaggaaaccacagaaaagcaggttgtggagcaaacagaagatgtaaagacagggacaacccgaaaaactgcagcggatgaactttcctatctttctaaaaaaaattgataattatagttttgtatcagcaaattatagtccggggatgaaatatggtaaatcaaccaccacgaatgtagcgatttctcctcagtttttaacaaaaatggcaaatgattcagacttagaagatgagtacataaaagaaattggtaacatgaaaaaactagatgagcagtttgcaaagcaacaagcagatattggatggagagttgaacagggatgggcaatagataaagatggaaatattagttcatgggcaataggacataaagattcaaaagtaaaatcctttctccagaatatgagtgaaaaagccgaagaaatcctacagaagcagttggaaaaagcaaaggatacaaaggaagaaaaagaagtattctcgatgaaaaagcataaagaagttataaaaaagaacaaggttgatttgaaggtgtaaataatcagattcgaagtattatgcagaaaaaatgcatagcattgagggagccttgcgtatgtcagatgaaatcaatgctcagttcggatttgaaagagtattcggtaagactaacggcaatgcagatactgatacaaaaattacaaaatttggcatctcttttaatagtgacggaactacaacattctatgcagagttagaaaaatcatcagccagtcagaaagaatatcttgaaaaaattcaggaaaagaaagctgctgagaagaaagagataaagaaaaaggaacaatccaagcaaatcgaagtacgaaaaactacggttcaggcaaattcaaaagaagaacttttggataagatcaaaaacgttgactgggattccatcaagtcggaggagaataaaatcggcggaagatttgatttttcagtttagtttattcagatgagaatagaagcaatttcataaaatcttacatacacacttgacaatattccgccgagcgcggcgtcggtgaaggggttcgcacctgtggtgtgccaacagaggtatcgcggatgcactcatggaaaaaatgacacctttaataatgaagaatagtgtacagaaatagcaaatgctgtgaaatcaatggtgtaaatatcagaaataaggaagctaaaagttgggcggcagattagttaataatttgccgcctatatacatttctctcctttataccgatacatcaatagaattatgaacgagtctattaccattttggacaagtgtagcttctacggattctcttgtgacattatcaagaatgcttgcatcaaatgcttgtccgggcttccaatttggattggctgattttactgccgcatacatagcagctctatactgtccttcatattgttctaaagtccatgtaccacttaaacgcttatctttgctgacacttaactgataatctttgaaaatatcggaacgtttcgttgtgtcaccatttgaaagacctttttcctgaataaattcccgcttcacattatcaaacattttttgacgatgctcttcggatatatttgtaagtttctgccatgatgtaccttttccagtaacatccatacctgcaacaccatttgaatttaataaatctccgtccgaatcaaactgcttcatcagatttttaataatcgtatcccttccaccgaatatttcatatatcatcttttcttccggagacatcatggattcattttcaattactccagataaccagcctttttctttcaatgccttatactgtttactatttgtattgatactattataggtattacctaaaccgttaatattcattgacatataaaagcctccctgcaaataaattcaaaatccgtttagaatcagtactatataatatatcatcgcaaattccagaaaattaataacacagtatataatataaaatgcttttcccgatataattaggtaagatttatgattggaaatgaggaaaagcatgaacatatgactttatagaatgtgcgtataatcataaaaaatatggttataatacttgcgtataatcaaaaaacaatttacaatatgcgtataatcataaaatatagaacaaatatatatgcgcataatctggaggagctatgatattaaaaagaaaaatatataaaaaactactggaatggaaaaaggagtgtcaggggaaaaaagctttactgatagaaggtgccagacgtattggaaagtctaccatctgcgaagaatttggaaaaagcgaatacaaaagttttcttctgattgactttgctaaaaaagataaggaagttgaggggtattttgagaaatatctgaatgatctggatacattttttatgttattacagacacattttggaacaaaactgacagagagaaactctcttattatttttgatgaggtgcagatgtttccacaggcaagagctgcaataaaatatttagtggcagatggaagatatgattatatcgaaactggttcattgatatctatcagagaaaatgtaaagaacatcgtcataccgtcagaagaaagacatatcaatatgtatccattggattttgaagaatttgcaatagcattagaagaagatttgctggttgaatatataaaaaaatgttttgaaaaaagagaacctttggaaagaagtatgcataatcaggcaatgcttttgtttcatcagtatatgcttgttggtgggatgcctatgcctgtagtaacatttattgaaagcaaaaaagattttacagaagcggatagagaaaaaagggacattcttaaattgtatcgggaagatattatgaaaatagatgcaaagtatcgaagtaaggtacttgcaatttatgatcagattccgggatttctttcacagcatgaaaaaagagttgtattcaaaaagctgcaggatggtagttacgcagaccagtacgaagaaacttttttctggctgtcggattctatgatatccaatgagtgctttttgtgtaatgatccgaatgttggcttatcattaaatgagacaagaagctatgtaaagtgttatatgggtgataccggacttttggtaagccatgcatttgatgaaaatgaattacttgaagatgaagtatataaacagatattggcaggcaaattacagattaatgaaggaatgctttatgaaaatgcaatagctcagatgctggtggcaaatggacataaattatatttttatacacactataatgaaaataagcatcgaaatgatatggaaatagattttatcatttccaataacagcagattaaaatataagatgtttccgattgaagtgaagtcaggaaagcaatacaaaacgacctcattaaataatttcagagaaaaatacaaggagcgcataggggaaagttatattattcatccaagaaatttaattgtaaaagatggaattatatgcattcccccatatatgacgatgaatatataaaaatctgacatacacaccaagttttggagaggatggcattatcagtaaaagattccaaaatggcaaggaactggaattcgcaggctcgaaagatttctggaaaaaatttttaaatgaatcataataatttacggatctttgacggcggcatcccaaaccgttttttaaacagcttgctgaaatgatagacatcatcatagccgacttcggctgcaacttcctggatgctgccgtcaaagccgttttccaacaattcttttgctttttcaaggcggatattgatcaggtggcggatcggtgtatcgcctgtctcacttttaaaaatacgtgagatataaaaaggacttaagtacatattttctgcaatctgatctaaagaaatcttttcactgtaatgatcctcaaaataatttacgatctggtcaactacatattttttgctggtagattcaaaagagcagccggtattgatttttaccggttcactctgttcccgaagcagcagtattaacatctgcatcaggtaactttttaacatgatataacgcccgcagcggcagatatcattttcagcactcatggcagtacagatcttaaaaagtttttgccgtaattcaccggaagtatgtaaaatcggagactgctctgcaggatcagcggctgggtcttttaaatgcagcggcagataattttccgggaaatccggaaaacggacatcacataaaccgacaaaaaactccgtggtcggattggcaggatccgtgcagagtgcctgatgcttctgccccggatttaaaataatgatatctccttcggacacatcatagagcctgtccgcaatcttgtatttgccgtggccggacaaaataaatgccatctcgataaaatcgtggctgtgatagcgtgcttcatctttcaaacgtgtgcctttccaggtaaatagaaaagttggattcagttggtcaagcagttgttcccggttgtcacagcacatagtaaggtctccatttcttcattttatcgccgataaaaacttattgtctatatttaaaatacaatgcgatgtggatcataaaaagtgtgtcaaaatgtgaaatatgggaatttgcgcgaagctggagatctttttgtgacttgggagaaaattagaaaatcttagtatgcctgtaaatacacagtgttgtgctgccacggatggcagcgcaagtcttaacgtgccatggagggcacgtttaagacgtacacgtcactttgaaagagcataaagcaggcatacttagtttttcttattttcggacaatggaacaaaatgaaaaccagcttcgcgcaaatttccagtttcaaagtctaaatacactttttgtgatccacatcacagtataacatattctccaccagaaaccatcccttccgttgcaaaaaataacatgaacggtgcaagatagtacattcctttttaccccagaagtactatactgaaaatccgaaagaaaaacgaaaagggagtaggagggttattatgacaccaatgaagtggttcttttcatttctgaaaaagtacaggggattaatgatagttggaattttgctgaccacagcggtatcagtgctttcggtggtaaatccgtacatatccgggcagatcgtagatcaggtcataagcggtggaaaatatgacagactgatgccgtttatcggatgtctgatcggagtcacgatcgtgatgggagtcttgcgttttctgtttcaggtcgcatttgagacggcgtcgcagggcgttttgtacgatatgagagacaaagtctaccggaaattattagaggaagattttgcattttacaataagaaacgtaccggagatctgatgagccgccagaccggagatatggatgcgatccgtcactttgtggcatatgtggtctatatggtttaccagagtgtgctgatgttcgtgtttgcactgcttatgatctttacggtcaacacaaaacttgcgcttgccatgcttgtggttctgccgtttacggcgtttgcaacctgccgtcagacgaaagaggtacgtccggcattcaagcgtaaccgtgactgtttttcctcactcaatgcgtttgtgcaggaaaatgtcagtggaaaccgtgtggtaaaagcatttgcaaaagaagattttgagattgaaaaattcaataaggaaaatgataaattccgtgcggcgcagatcgatgcgtcaaagatctggatgaaatatgtgccgatatttgaggtgctttcctatgcgctgacgatcattctgatcctctacggcggctatatggtcattcagggagagatcacgttaggacagctcgtgacggtgaacggctatctgtggatgttaaacaacccgctgcgccaggcaggatggctggtcaacgatatcagtaactttacaacgtccgtggagaaaatctatgcgacttacagtgaagagccgcatgtaaaaacaccggtatctggagtagtcaagaaacatctgaaaggtgagatcgagtttaaaaatgtatcttaccgtgcggatgacgaagatattgtcatggatgtcaattttaaggtaaaaccggggcagaccgtcggcatcattggttctaccggagctggaaaatcaacgatcatgaatctgctctgccggttttatgatacgacttccggtgaagtgcttgtggatggtgtgaatgtccgcgacatggatctttataacctgcgtgacaatatcggcatggcgatgcaggatgtgttccttttttcggatacgatcgaaggaaatatcgcatacggaaggccgaattgttcgttcgaagaagtcaaacaggctgcgatcatggcggatgccaatcattttatccaggcacttccggatggatatgatacgattgtgggtgagcgcggtgtcggactttccggcggacagaaacagcgtatctcccttgcgagggcactgctgaaagatccgtcgattctgattcttgacgatacgacatcggcggtcgatatggagacggagagttatatccagagccagttgaagaaattagataacaagtgcacgatctttgtcattgcgtaccgcatttcttccattagagatgcagatctgatccttgtcatggataacggacgcatcattgaacagggaacacatgagcagttagtggcggcgggaggttattacgcgacggctttccataaccagtatggcgagatcccacaggaaattttaaacggaaagggggagaaataagatggcaagaaacagatatgatatggatgagatattagaggacagttttgatgtaaaccagctcaaacgtcttgcaggttacattgctccctacaaaaagaagatggcaggcgttattcttctgatgctttcttcctcggcacttaccatggcgatcccgatctttttccagaatgtgatggatcacagcatcccggaaaaagatatgaaatcgatcacattttacagtattgcgacattgctgatcgcactttattcgggtatttccctgcggatcaagatcaagaccatgagtgtgatcgggcagaatatcgtacatgatatccgctatgatattttctgtcatctgcaggaacttccattttcctattatgatgacagaccacatggaaaaattcaggtgcgtgtggtcaattatgtgaacagcctaagtgatcttttgagcaatggtattgtcaacacattcacagatctgtgcaacctgatctttattctgatgtttatgtttgcactcgatgtccggctgacgctgatctgtctgtgcggattgccggttcttgcatttgtgattatcttaatcaagaaaaaacagcgcagggcatggcagatccagagcaacaaacagtcaaacttaaatgcgtacattgcggagagtatcaatggaatccgtgtgacgcagtcttttgtaagggaaaatgagaataccggaatctttaataacctaagtaaaaattaccggaaatcctggatgcgtgcggtaatgtttaactttacgatgggaccgagcgtggatattatttcgacatttacgacggcactgatctatgtgctgggtgtccgttggattttagcaccggatatgacactgaccgtcggtgttctgatcgcatttaccgcgtacattgggcgtttctgggcaccaatcaacacacttgccggattttacaattctcttttgacagcaatctcttatcttgagaggatttttgagacgatcgatgagccggtgggtgtcagggatgagccggatgcaatcccgatgccggaggtggcaggagaagtgaagttttcccatgtgtcctttggttatgagccggggcagaagattttggaggatatcaattttacggcaaaaccgggtgaaacgtatgcgatcgtcggcccgaccggggcaggaaaatccacgatcgtaaatctcatcagccgtttttacaatgtggattccgggaaaatcacgatcgatggcattgatatctcgaaggtgacacttcattcactgcgcacccagatgggaatcatgatgcaggacagctttatttttgcggggacgatcatggataatatccgctatggcaaccgcagtgcgacggacgaggaagtcatccgtgccgcaaaaacagtctgcgcccatgattttattatggaaatggaaaacggatataagacacaagtcaatgagagaggaagcaggctatccgccggacagcggcagcttatttcctttgcaagggcactgcttgcagatccgaagatcctgattttagatgaggcgacgtcaagcattgataccgagacggaactgcttttacagaagggattaaatgagcttttgaaaggaagaacgtcctttatcattgcacacaggctctccacaatcaaaaatgccgactgcatcttatatgtagacaaaggcgatattttagagcgtggaaatcatgacgcactgatggaacagaagggtgagtattacaaactttatatgtcacagtatgatttcttaaaatgacaggcactgcggtgccatttgccaatcgaaaaaccggaaaacaccatttgacacccggatcttataaataaaaactgccgcctcacggtgatatgtccccctttttctgaacttacagagaaaagggtacatatattcacccggaggcggcagtttttatgaaagtttattcatttttatgttctttccggtattctgccgggctttttccaacgtattttttgaacttgatatggaaataatcgacattccggtaaccgactttttctgcgatcgcataaacttttaactctgaggaacagagaagctccatcgagtgtttgatgcggacatggtcgacgtatgagttgaagttttcacccatctttttgcggaaaatctttccgagataggagctgttgtaaccaaaaagcggtgcaatattttctaatgtgatattgcttgcatagttgtggttgatgtagtgcagaatatcatccagcacgctttcacgggaagagttaccgatcgaggacatgatcatctcaaactgttccgtaaagtacaggatgatctcgtagagataatatttttcttcgatcagacggatgatatccgcattgctcggaaacgggatatttgcaccattgtaaagccggtttgcctgttccttgatctgcagataaaggtctgtcaggaaaagccgtatggaatcaatcgaatctgcagcatggtaaagttcattggtaagctgtgtcaaagtctccgctaacatattgcggttgaatgcctgaagatattcaaacaggctggtagcgtaacggtttaaaaaagcgtcgtttaagatggattttaaactgtccgggtccggcagttcggcataaccgatcgtgtgctgttcctgctcgcagaagaaacggcgttctaagagctgtttcgcctgaatataggaaatatagacttccgacaggtctgacacgcgcgcaccatatgtaataaagagactgtcaagaggagaattctcctgtggacgccgttctctctggtaacgctccagaaaatcgttaaacttttgaatggcaaaagtgcctttcagcaaaataacctcatgatactgcagcgtaatgttatcgtaggagttattatcctgattcgtcacgcgcagaagatccgaaaaacgataggaggcatctgcagtattgtgactgtatttctcatagatcacaacctgataggtgtctgctgtcagatggagatctgttgtatttatgtgggaaagatcgatatcattcgttaaaagatcgcggatgatggtctctcttgccttttcacggtaatgttcccgggtatttgcagttgcagcagccttgtctaagttttctttgatcgaacgaagaatctcctcaagttcatcctcgtcgatcggctttgtcagataatactgcactccgtaacggatggcttcctgcgcatatttgaaatcagagtaaccgcttaagataatgacttttccggtaaaaccctgtgctcttgcctcccggataacgtcaagccctgacattcccggcatgcggatgtctaagagaacgatatccggctgtaaggcaagaatctgctgataggccgtctcaccgtttgcagcttctccggcgatcgtatagccgagagattcccagtcgaacagacatttgataccttcccggataatggattcatcatctgcaattaaaacgcgatacataaaaataaccttcctgttccaatgataaaagtactaaacgtaagtataaatgcgaacgttttgtttgtcaaatttatcgagtgttttatgtacaatttagagggtattttttgcagggtgggtatagtaagatgagacaaaatgagataattacagggaggaaaatcctctgctcctgatagcagtcgcattttccttcggaaaacagggaggattatcatatgaaattcagtaatggatgctggctgcagaaagagcgctgcgagtgcttttctccggcagaagtatatttttcaaaaatcgagaaagatcaggtgacgatctgtgcgccgacaagcaagatcacacagcgcggcgatacccttggcggaatcaacctcacgatcgtgatttcagcaccgtatgaggaagtgcttagggttcagacttatcatcacatgggcgtgcagaaaaaggcaccgtcatttgagatcgcacctgcggagagcggacatttaaaggcagaagatacggaggacaaactggtcatttcaagcggtacactgcgtctggaagtgcagaaagagaacggagcactcacattttaccgcggtgaggagaaaatcactgcaagcggatggagagatcttgcatacatgaagaccgactggaaaggttttgcctatgataaaggaccggaagatgcttatatgagagagcagttatcactttccgttggcgagctgatctatggacttggcgagcgtttttctgcgtttgtaaaaaatggacagagcgtggatatctggaacgaggacggcggtacttccacagagcagtcttataaaaatatcccgttttatatttccaataaaggatacggtgtgtttgtaaaccatccggagcgcgtgtcctttgaagttgcaacagagatggtaaccaaggttgaattttccgtgccgggtgaaaaccttgactatttcctgatcaacgggccgacgatgaaagaagtgctgatgcgctatacagatatcactggaaaaccgtcacttccggcaccgtggacattcggtctctggctgtccacatcctttacgacaaactatgatgaaaagacagtcaacagttttgtcgatggaatgtttgaccgcaagatcccgttatccgtattccattttgactgcttctggatgaaagatttcaactggtgtgattttacctgggattcaagagtattcccggacccggagggcatgttaaaacgtctgaaagcaaaaggattaaagatctgtgtctggatcaacagctatgtgggacaggagtcatccatgttcaaagagggtgtcgagggcggttacttcttaaaacgtccaaatggcgatgtatggcagtgggatatgtggcagccgggacttgccattgtggactttactaaccctgcagcctgcgagtggtacagcaaaaagttagaggcactgctcgatatgggtgttgactgcttcaagaccgactttggtgagagaatcccgacagatgcggtatattacgaaggttctgatccggtcaagatgcacaactactatacatacctttacaataaggtggtatttaacgtattaaagaagaaaaaaggtgaaaaagaggctgttctttttgcacgttctgcaactgcaggcggacagaagttcccggttcactggggcggtgactgctggtctgattatgaatccatggaggagagccttcgcggaggcctgtcactgacaagttccggttttggatactggagccatgatatcggaggatttgagagtacctccacaccggatgtctataagagatggtgtgcattcggactgctttcttcccattcaagactgcacggatctacttcttaccgtgtgccgtgggcatatgatgaggaagcagtagatgtggtacgttatttcgcacagcttaaggcatccttaatgccgtatctgtaccgcaatgcgatcgagacatcaaagaccggtatcccgatgatgcggagcatggtgcttgaatttaccgaggacaagaactgtgcttacctggcaacccagtatatgttaggtgattccttactggctgcaccaatcttccgtgatgacagcatcgcagagtattatctgccggagggaacctggacatccttactgaccggagaagtcaaagagggcggtaaatggtatacagaaaaacatggttatttaagcattcctctctatgtcaaagagggcagcatcgtggctatgggtgcaagaaatgacaatgcggtttatgattatgcggacggagtgacattccgtgcttatgcattgaaggatggcattcaagcggagactgttgtctatggaacagaaaatgaaaaagaagcatctgcagacgttgtaaagaatggaacttcctatgaaatcacagtggagagcaaaaaggcatccaaagtggcattgatgaatgtcggtgctccaaagcaggtaaccggtgcattctatacacaggatggggaaaatgtcatcgtagcatttgacggggacggcaaggctgaggttgtattttaatgcaggaaacatacattgaagaaattttaaaagagctgactttagaagaaaaaatcggtatgatccacggtgcgggtttattccgcaccgaaggagtggagcggctttccatcccaccgctctatatgtcggatggaccgatgggagtgcgcgcagaatttgcggacaatgaatggcggaatgtcgggacgacggaagattatgtgacttatcttccgtgcaacagcgccattgcatccacctggaatcgtgcgctggcaaagaaagccggagaagtgctgggcgaggaggcaagaggcaggggcaaagatgtgatcttagctccgggcatcaacatcaagcggagtccgctctgtggcaggaattttgaatatatgagcgaagatccgggactcatcgaagaactggttgtaccgatgatcgagggaatccaggaaaacgatgttgcggcatgcgtgaagcattttgcggcaaattcacaggaaactgaaagactctgggtggatacaatcatcgatgagacagcactggaagaaatttattttccgggatttcaagcggcggtagaaaagggacacacccttgcgctgatgggagcctataatctgttaaacggtgagcactgctgtatgagtaaatccctgctcaatgaaaaactgcggaaagactgggcatttgacggtgtggtaatctccgactggggtgctgtgcacgatacgaaactggctgcagagtccgggctggatcttgagatggatgtcaagtatcagttcgacgaacagtacatggcagagcctctgttaaaagcagtgaaggatggagaaatcgaagaatcgctggtggatgagaaagtgcgcaatatcctccgcatgatgctgcgtttaaaaatgatcggaccggagagaaaacatcgtaagacaggcgcatacaatacggaggaacaccgcagggcagtgctcgatgtggcgcgcgagtccatgattttactgaaaaatgaagatcaggtattgccgcttcaggcagaatccggctgtaaggttgccgtgatcggcgcaaatgccgctgcgatccattcgaacgggggaggaagtgcagaaatcaaggcactgtatgagatatcaccgcttatgggaatcaaaaagttacttggtggaaatgtgaaagtttcctacgcaccgggctatgtgattccggataagaaagaggcatctgagatcaactggcaggcggcgagcacggagactgcagagaataccgaaaaggaaagcactgtaagtggaagaacactggatgaaaaacagcaggaagccttagcggaagcagttgcgctggcaaaagcaagtgacattgttatttttgtgggcggactgaaccacgattttgatgtggagggacttgaccgcgtgaacatgaaactgccatacgggcaggatgaagtaatcgatgctctgctaaaggccgtgccggatacggtggtctgcatgtatgcaggtgcaccggttgagatgccgtgggcagaaaaggcaaaagcaatcctctggagctactatgccggtatggaagggggaacagccctggcagagatcttgtctggaaaagtaaatccatccggaaagctggcagaaacatttatccgtgatgcgtcgcagtgtccggcacatacgatcggaacatttggaaagaaagaccgtgtggagtacagggaaggtgtgatggtcggttaccgttattatgacacaaaaaaaacagatgtcctgttcccgtttggtcatggactttcctatacggcatttacctataatgatcttgaaattatacggcagcaggaaaatggcagacagaccgtgaaagtttcctgttcggtaaccaatacaggagaacatgcagggaaagaaaccgttcagatttatgtggcaccggaacagaaaaaagacagaccggttcatgaactgaaagcgtttgaaaaagtcgggcttgatgccggggaaacaaagaggatctgtgttattttggaagaaagagatttttcccattatgacacagacaaaaagatgccggttccggtaaatggaacgtatgaaattcaggttggcgcatcttcgacagatatctgcctttgtggaaaaatcgaccttttttttgcagaaggttaaatgatgactattgaaaagaaactctgactttgctatgataaagtcaggtttttttttatgggatttttttggggcggataggtgagaatatgtctgaaaagagcaaggtattagtcgtagatgataaacaggtcgaacgtgtcatgatgaaaagaattttgagcggtacgtacgaggtgatagaggcagaaaatggcaaggaagcatttgagattctttatgaacgaagcacggagataacggcggtacttttagatatcgttatgccggagtatgacgggtattattttctggaacggtatcataaagcgcagatgtatcaggcgatacctgtcattgtacttacgatggaggttgacattgagacagagattaaatgcctgggcatgggagcatgggattttatccggaaaccgtatgatgtggatgttgtccggttccggctgaagaatgtgactggcagcagcagtcagaatatcagcaaagcattaaagtaccgtgcagaatatgatatccttaccggcatctataataagaccaatatgtttcaggcgacatctgctatgttagagcgatatccggaccggcattttgcttttgtgcggatggatattgaaaagttccagctgatcaattctttctttggaatgagtgcaggggacatgctgctgaaatatattgccgaccttttgatatgtgcagtcagaaaccgcagtgacgttacctttggcaggatggatgcggatatattctgcttctgcgtatcctatgaaaatacaaaagaactggtcgaaagttttgataaaatgcgtgatatcttaagcagatacccgcttgattttgatatcgtaccgatatttggtgtttacctgatcgctggaaagaaaataacaccggatcacatgtacgatcgtgccaaccttgcggcaaagcactgcaaaggcaattatatccgtaactatgcattttatacacggcagatgagccaggagatcgagaaggaacagcggatcgtaaacagcatgaaaagtgcactggaaaatcatgaatttgttgtattctatcagcccaaatacgggctcagcgataatcagatcgcaggagcggaggcgctggttcgctggaaacatccggaacggggaatgatttcaccgggagagtttataccggtatttgaacggaatggatttatcacaaagctggattattatgtgtgggagcagacctgcatccagcttagaaagtggatggatgaaggaaagaatccgcttccgatatccgtcaatctttcgagggtcagcctttacaacaaagatatcgtgaatgtgatctgcaatctggtggacagttaccggattccacgcagactgtttcaggtagaactgacagagagcgcatacaatacaaatcccaaagcagtgcaggatatgatgcagcgtttgcgcgaagagggattttacattctgatggacgattttggaagtggttattcttctttaaatgttttaaaggatattgtggttgatgttttaaagatggacatgaagttttttgccggtgatgacagggaaggacgcggagaaaatatcatggcggcagtgatccgtatggcaaaatggctgaatatgccggttgttgcggaaggcgtggaacggatcgaacaggtggaatttttgcggagtattggctgtgaatatgtacagggatattattttgcaaaaccgatgcctgtggaagaatacgaaaaactgcagtttgacagaccgcatgcggagagaaagaaagagacagaacgcttagttgacatagatagcctgtggacgccggcctcccagctggagtcactctttttaaatgcgaaacagggtgtggctgtctatgagtacggcaaagaacagattgagataatacgcgtaaataatgcgtattatgaggtgtttggatatcaggatatcagtcagaaaaaagatatttttcagggaattccaaaacgatatcataagcgtattctggatgcctttttttatacagcagataaaggacgtgaaacacaatgtgaattttccaggaagaatgaagcaggagaagaaatttttatatcattaaagctgtatgatgtaggaattgtaggaaataaacatatcatatatggtgttttcttaaatgtgacagaaccaaaacaactggaatgggaattagaaaaatacaggctgttattatccggaaaaacgaaagacagggagatggaacaggaaaaagaacaatcggaggaatgatagaaaaatgtgtgaggtattggaaaaattaagagcatggggatgcgatttagatggagctttagagcgttttttaggagatgaggaattatataaaagctgccttccgatggtggcagaggacgaggcttttgatggattaaaagaggcacttgcagaagatgagagaaaaaaggcgtttgactgtgcacatactttaaaaggtgtctttgccaatatgggaatcacaccgatgtttgatacggtcgaaaaaattgtagagccgcttcgtgccggaataaatgatggactgatgccggtatatgaggaattgtccagggaaagagaacatcttagaagcattatccggatcgagggagaataagacgcgtgaagatttatatgacggatattgttccatttggggatgaaaagatatttgcacagatgctgccttttatcacggaagaccggaaaaataaaataatgcaattgaaaaaaaaagaagaccggtgcagatctttagcagcaggattattgttagagtatgccctgagggaatatggaatcagtctgttaccagggaaaatgcagcagatgtatcttagattcggagagaaaggaaaaccggtattaaatggaaaaaccggtatacattttaacctgtcacattcgggaagatatgtggcaggtgttttttcagataaagaagttggaattgatgtggaacagatccggaaaggacagatgaaagtggcagaacgttttttctgtccggaggaatatctggcattacaaaaggaaaaaatgaaaaaagcagactgttattttacagagttatggacaagaaaagaaagttatatcaaagcggttggaaaagggatggcattggatcttgcatcgttttgtgtactgcaggatcaggttaaatttttaaaagcggggcagacgggagaatggtatctgcaaagctatgatcccgcaagtggatatatattgtcagtatgtgccaaaaaatgtacaaaatgcgagattcaatggatcagtaaagagatgtttacacagaaatttatttgacggaaaactggaaagaatttataataatcgctgaaatgacaagtaaggaggaagattcatgtacgacgaattgaccgaacaggatataaaaaagatggaagaggagattgaataccggaaacttgtggtgcgcaaagaggccttagaggcagtgaaggaggcaagagcgcagggagacttaagtgagaatttcgagtaccatgcggcaaagaaagataagaaccagaatgagagccgtatccgctatttagagagaatgatcaaaacagcaaaagtgatttcaacggattctgcggaggatgaagttggtatgaataatacggtgacggtttattttgaggaggacgatgaggaagaagtttataaacttgtgaccaccgtccgcggtaattctttaaagaatctgatcagcaatgagtcaccgcttggaaaggcattgcttggacataaggtcggtgaccgcgtggaagtggctgtcaatgagaattattcctattatgttgtgatacgaaagatcgagaataccgtggatgacggttccgataaattacgaagcttttagcagaaagagggatttatgagacttacagaattattaaatacagagaatgtaacgatttcctgtgaattgttcccgccgaaacagggtgcacagttagacaactacaaaaagattgtcggagatatggcagcattgaaaccggcatatatgagtgttacttatggtgcaaccggcggaacttctgattatacggtagaacttgcaaatgaagtgagaaatgtgaatcatattccggcactggcacatctcacctgtgcatcttcgactaaggagaaagttgcctctgtgattcaggagttaaaagaaaagcagattgaaaatgtacttgcactgcgcggagatatcccgcagaatgcggatttcccgctgccaaatcagtataaacatgcaagtgagctgatctatgatatcaaatcacagggagatttctgtatcggcggagcctgctatccggaaggacatcctgagtcacagacattagaggaagatctgatccatctgaaagaaaaagtggatgccggatgtgagttcctcacaacacagatgttctttgacaataatattctttataactttatgtacaaagcactaaaacatggaatcgatgttcctgtcgtagcaggaattatgccgatcaccaacgcaaaccaggtaaaacggagcattgccctatccggaagtttggtaccgcgccgtttccttgcaatcgttgaccgttttggaagtgacccggctgccatgaaacaggcaggtatcgcctacgcgacagaccagatcatcgatctgatcgcaaacggtgtcaatcatgtgcatatttatacgatgaacaaaccggatgtcgcaggagcgatccttgagaacctttcggatatttatgtgagggattagtacggctatttgtttccggacaaaatatatagcttttatgaaaaaaataatatcattagctgcttagaaatggagattaatgtgaaaaaacaggaagaaatttttcgtgagatccaggagatgatgggagagacaaaagaaggaagaatccgctggagtgtagaggttatgactaccgaggcaaatccggcagaagaaaaacccgttgagcatgaggatggattagactggacgattgatgagtgctatgtttcttactattgtagatataaaggaaaagatttttgtctgatcacttatgaaatgttaaaaactgcaaacagaagcataggagagcagaaagtaaaatcaagcaatatggtatttttaccaccacttggcatgcgtttttttgatattcatgcactgctgccatatagcatagaggtatcgaatgtattacttgacgcaatacaccgtctctgggtaatgctgcttgatatgtataaagtggacaagggcagtatctatttgaatgtaagacccggaacactcacgatcgaggatgaaaagaattgacaggaacgatttttacgtcatgatcatttaggggagaagaggtaatatctgttgaaaaaacaaaccaaaacagccatgaagctgtctgttattgctatgattgtgtctgcatttatgatgctggcagcctgcacagaaacagtgcagaaacaaaagatacctggtgcaacatatatgggagggaacaatacgattactgagatctgtaaagaacttgactctgcgggagctgcgcatgtagacatatttcgggaatgggcggttgattttgcagattccgcaggaaaaaatgcaaagctggaagatacatggtcagatcctgggaaaatgaaagcggatatcggtaaatgtatggatggctgggaacagaatcatgattattcagatgcggactgtagaatgacagcttttctcctgttagatggggtgatccgctcggaattaacggaagatcattatgagggaacctatctgatgtttgacacagaagcgatagataatgtggacaggtatgaaatcataaaagagaacaaagatatgtttaccacactttatggtgaaaagagtgttacggatgacagacatccggaatctgcattttgcgacagctggaaagaatatggatttcaaatagataatgacagaatatcgcttcttagtatcgtaatatatgatccatatacggatgctgtttttgtaggtcatactggtatcctgataaagtatagtgattattatttgtttgtagaaaagattgcatttgaacagccatatcaggcaactaaggtgcagacgattgatgaactgctcgatatcttgtccttaagaccggaatattttggagaagagggagaacccggaccatttgtttatcataatggagattatattggaacgttaaagagagcgacttaagaaagcataaggagaattcagataaaaagaaagctataccggtaatgggagagactttcagatacctcccggcaggtatctgaaagtccgggagtgaatgaaaatagaaccgttgggtatgattgccggttatgtacaaaagagtatcataaaagggttatttatttgagctgtctgcatcgattacagattggatctgtttcatcagagtatcatagttatcctgattatcgattccaccgagcatcggatcacccacgatgttaccatttctgtcgacgagtattgtggtaggaaatgccatgatattggaggcatatttgcctgcatctgaagatgaatcaatagaaagattgcggtatttagcaccttggctttcaagaacagaggcagcttctttgatagccgattcatttccatcgaaggtttctgtgttgatgccgactacttctcctcccattgccctgactgcatcatttaattcattcagtttggataactcagcaacacaaggcttgcagccggtaaaccagaaattgatgacagttactgcattttcggaaaaaagactttcgtcaacagaattaccatcgaaatcctgacctgagaaatttttgaatggtgatgcatcttcagaattagtattctgcccatttttatcggattctgtagtttctttttcaatttctgcgatctgttcttcgatttttcgtatggtttcaatatcatcagtaagtgttttgaattcgtcatcagtaaaagaatctttgtttgattcagcggtatcagccagataatcagcataatttccgtttgaatctgcagtgtttttattcatcagaccaaataatttgtcccatatatctttatgctctgcaaagatccggttctcctgctgatataaatcatccagctttgtgttggaattgtccgcagatgccgtgctgtcttcagccgtggtattctgtggttctgtggtgcttacagttccttttccgctgcaggatgtaagcagcagtgcgatgctgagtgtgacaactgaaataaatgtaatttttgttttcatggataattgctccttttttaaattgtaataagattgatagttactggtttatgactgctggttactgttgttcttttttttacatgatttccccataaactggtagtggatcgcatctttaggacaggcttttatacaggctccgcatcgtatgcattccggatgatctggagttttacacacatccacatccattttacatgccttttggcattgcccgcatccgatgcatctgctgttctcaattttaatagaaagaaagctgaccttattaaataatgagtagattgctcctagaggacagatccatttacagaatggtctgtaaaacaaaatacttaacacaattactgtgattaaaataaggcatttaaaagaaaaaagttttcccagtgcagaacgtatagcggcatttccaagtgcgagagggatagctccttccaggacaccctgaggacaaatatatttacagaagaaaggatctcccattccgatagagttcgttaccagcatcggaagaagtataacaaaaatgatcaggatgatgtattttaaatagcgcagcggtttgagccgggctgtagaaaattttttcccgggtattttatgaagtaaatcctgaaaccatccaaacggacacagaaaaccacatataaatcttccgagtgttacaccgagtaaaataaaaaatccggttatgtagtatgaaaatttaaatcctgatgaaccaacaaccgcctgaaaagcgccaattgggcatgctcctgttgccgccggacaggagtaacaatttaatcctggtacacatacgttttttacgctgccctgatatatttttcctttccataaattaggaatatggatattcgtgagcagtgtggcagctgcctgtatccatccgcgtagtacagctattttttttgatagaaaattcttttttttatccaattccgacacactccagacataattttattgctttaccgagcacgacagctgcttctcctctgaccgcaccgtaacttatcatggtgatacctgagatgagcaggatcgactgatagatttttttgcacttcaagatattttactcctttcatttgttgtatttattgaccagctgatgttagtattatacaatagctgttgtaaaatttgtgttaagaagcgggtgaatgaattttgagattattgatagttgaagatgagaaacaaatgtgtgacatggttgcaaaacggctgtatgatgcagggtacgaggtggatacctgttatgatggggaagaggcttttgaaagtgtcctgacggagaattatgatctgattgttctggatctgaatctgcccggtatggatggaatggagatcttaaaggaactcagacagagaaatgaggagacgaaggttcttatattatctgcaagagggcagattgcggataaggttgaaggactggatgcaggggcaaatgactatatggaaaaaccatttcatctgcaggaacttgaggcgcgtatcagaagtctgacaagaagaaaatttgtgcagaaagatgtgtgtctggaaagtggtgggataaagttcgatacggtaagacgtgaggcatatgcaaaagggaaaatgatttccctgacaagaaaagaaaatggcattttggaatatttacttctgaatcctggaagaccggtaagtcaggaggaattgatggaacatgtctgggatgcatccgtggatagctttagtggtgccatcagagtacacatgtcttcgcttaggaaaaagcttaaggctgaacttggatatgatccgattttaaacaaggtgggagagggatataaaatacgggaggagtctgaacgatgaaaagaatgtcactgcagtggaggcttacctgtatcattacagtatatattgcagttatatgtggatgtctgacgatgtttgtctataaaaatggcgtgtattatatcgattccctgcaggagactgtggatgcccagggagaggataacggggaggatacggatgaaatatatatcagcattccagatgataagtgggatgagtttgccaatgatttttctatccaggcatataataataaggaagattacaaaaaaaacagtctgctgatatcagccatattggcatttattggcggggtagttacatattttataagtgggcatgcactcagaccaatccgtgaattttctgataaaattgaagaagtacaggcgcaaaatctggcagcttcacgaatagaagaaaataaagttaaagaattgaaccagcttagcgtttcgtataataagatgcttgaacgtctctcggacgcatttgagatacagaggcaatttaccgcaaatgcagcacatgaactgcggacaccattatctttgatgcaggtacagcttgatctttataattctacacggcatccggataatgatgctgacacattgcagacaataaagatggttaccgagcagaatggaagactcagtaaaatggtaaaaacgctccttgatatgagtgaactccagactgtgggacgggatgatgaaattatggttgacgcgcttgttgatgaagtgttagcagatctggatccccttgcacaggaaaaaaacataaaacttactggaaaatgtaaaaatataacgatggttggaagtgacattcttatttacaggctggtatacaatcttgttgagaatgccataaaatataatcattcgggcggacaggttacagtaactgcataccggaaggaaaaacatgtttatctgtccgtggaggatacgggaaacggaatccctgaggaactcagggaacgcgtgtttgaaccattctttcgtgtggataaatccagaagccgggaacttggcggtgtaggacttggacttgcgcttgtccgtgaaatcgtgagagtgcatgatggcagtattgcagtcagatcaaatccgtctggaggaacggtttttgatgtaatattaccactgtgatcgatcataacttattagttacatctggctgtctcgtgcatggggtatttcattcttttctattgaactataaggcagattattttcagaaaataattgtttatttatcccaggattttcagatttttgatgggacgatcagagaaaatattttatttgacagaaatgtcccggacgatgagatcatgatggcactggaaaaggagaatctttcctgcctggttcgtgattctgccaggggacttttgtggaactgatgaaatcagatccgtattttacggaactttatatgtcacaggataaaaaacttgcattttgagaacaggcgtgtataataaagctgttataaaaaaaacagatcatcacaaaagtgatgtcgaaaacaaaaaatggggtgctcgcacaggcgggctgagagtaagcggacgctttaacccggaacctgatttggataatgccaacgtagggagataatgaatcacaagtggtttttgtgcaggaatctttggttgggttcctgcactttttgtttttggtcgattgcgccgataaggctgcatgaagataaatgatatattacagcggcagattgggggcaccaccttaggtcgctatacaaaattaatgcaatatggaaaggaaagataattttatgtacacagcattaacaatcgctggaagtgattctagtggaggcgccggcatccaggcagatattaagacaatgaccgcaaaccgcgtatacgcgatgagtgcgatcacggctctgactgcccagaatacgaccggcgtaacagatattatggaggtaactccgaaatttttggcagagcagctggatagtatttttacggatattcatccggatgcgatcaaaaccggaatggtctcgtcgagtgaattgatcgagacaattgcggaaaaactgacagagtatcatgcaaaaaatattgtggtggatcctgtcatggtggcaaccagcggggcaagactgatcagcggggacgccatcagcacattgaaaagtaaattattgcctcttgcaactgttattactccgaatatcccggaagcagaagtgctttccgaaatggagatcaaaacagaagcagatatggaaaaagcagcagaagtcatttgtaacactttaggctgtgcggttttattgaagggtggacatcagttaaatgatgccaacgaccttcttttccagaaaggaaaagagccggtgtggtttcatggaaagagaattgacaatccaaatacccatggaacaggctgcacgctttcttccgcaatcgcatcgaatcttgcaaaaagaagggatttagaaacttccgtcaggtatgcgaaaaattatatttccggcgcacttgccgccatgcttgaccttggaaaaggaagcggacctatgaaccatgcatttgcgatcgaaggagagtacgaaggatgaatgaaaagagaacttccgttttttcaaacggattaatctggtttggtgcgggcgtatctttagccgaaatactgacaggtacatactttgcaccgcttggctttggaaaagcaatggcagcgattctgctcggtcatctgatcggcggacttatgatgtttgcggcaggaatgatcggagcgaaagagcgcaaaagtgccatggaaactgtaaaaatgagctttggcgagaagggaagccttctttttgccgtattaaatgtattacagcttgttggatggactgcgatcatgatctatgatggcgcacttgcggcagacggcgttttacataccggaaactgggtgtgggcagtcatcattggtgctttgatcattgtgtggattttcattggactgaccaatcttggcaaattaaatacggttgccatgacagcactttttattttatcactggtactttttaaagtgatcttctttggcagcggcagcatgacgccgatcgtggatgacggaagtttgacattcggagctgccgtagagcttgcggtggcaatgccgctttcctggctgccgctgatcagtgattatacaagagaagcagaaaaaccgtttgcagcaacactcgcaagtgtgattgtctacagtctggtcagcatttttatgtacatgatcggtatgggagcggctatttttaccggtgaatatgacattgcgcagattatgttaaaaaccggtttcggcgttgtcggacttctcattattgtattttccacggttacaacaaccttcctggatgcctattccgcaggagtttctagtgtttccatttcctcaaagattcaggaaaaatgggcggcaattgttgttactgtgattggaactgtcgcagcaatcgtttatccgatggataacattacaaactttttatatctgatcggttctgtttttgctccgatgatcgcagtgcagatcgcagattacttcattttaaagaaagcagatgccggaaaatctgcatttcagtggcgtaatctgatcgtatggcttgccggatttgtgatttaccgcatattgatgcaggtggatacgccggttggaaatacgctgccggatatggtggtcacagtcattctctgcctgattgtggaaaaagctgcaggggcagtaaaatcaaaataggaactgttgcagtcttatcattctttttttagaatgtggtatgtggcagattctgggaaaagaggacaaaatgaaaaaatttaatttaaagaaattgacagttacagcaatcttagcagcagtagcggtggtgggaagtttattttccttcccggtattcggttcaaaatgtgcaccggtacagcatctggtaaatattttatgcgcagttaccgtaggaccgtggtgggcactggcacaggcatttattgcggcgctgatccgtaatctgttaggactgggaagccctctggcattcccgggaagcatgtgtggtgcattgcttggcggacttctctataagtatgggaaaaaacttccatttgcctatattggcgaagtagttggaaccggaatcattggtggaatgctctcttatccggtggcatatcttgtcatgggtaataaagcagcggcgttattcacatttgttgttccgtttctgatcagcacctgtggcggaacgatcattgccattattattacactgccgttgaaaaaatcaggaatgcttggcagaatgaaggaaagtttagaagagtaagatagaaatcaaaaattttggattatcatttaccacgatccggctggataccgtgggtttttaaagaaaatgtcggaggctctgctattgttggcggagccttttttaggttactgttcagaccattgtaaaaactgacgaaatttaaaaaaatatatttgtggataaactcaagcaggatgggaagtctcgttaacgacttccgaatcctgctttttcttttgaaattataaacagtacctgcatgttttcctgcttttacatggctggaatacggatttccactcctgcttctttcatttttctgccggttatccaccgtcattctgccagtcccgtaattcgtccgatttcccattcgtccctgtttctgctatacttatcctatacttaaggaggcacaaatgaacgcagatgataaaagcaaactcaaagcatatgaagaacttataggcagtcttgagcatacaaacggactacagcacagggtcatcgaaacccagtcctcattgatcaaatcccttgaggaacataatgcagaattagaaaaaatcattgatgatctgacaaacatttaaggaaaggacgcggcatggggatggggaattcttttgaaaccattacagtacttcaatacaggctgaaagcagcacaggaagaacttgcagcctttcaatcgggagaaaaatatatccgaatggaaaaacagcaccttacacaggtgcgtgccctggaacgcagaattgcaaaactggaagcagctgtagcaaaagaacacagccatgccattacgattcggaatcaatggtttgagatttttgaacagctgcaaaaagaatgcgaccgtatggtcgccgaagcagtaaaaaaggcggatatgatggaaaaaagggccatccgtgcagaaaaacagcgcgacatcgcccttgaaaaagtaacttcccagagacgggaactttacaaagtaaagacagagcttgatgatgaaaaacaaaaagtacagaaactgacggcacagattaaccggaactatgaaaactcatccatcccgtcttcaaaatctatcgcccgcaaaaaaatatccaacagccgcgaaaaaacaggaaggaaacccggtggacagccaggacacagggggcactgcagaaagaaactcaccccgacaagggaaatctatcttccggcacccgaagaagtactccatgaccctgactttaagaaaacatcgaaaaccattacaaagcagaaaatcgacatcagcgtagaagtgcatgtgaccgagtatcatgccgatgtgtactataattccaaaacaggtgaacggatccatgcaccatttccacagggagtcattgatgacgttaactatggaggaaatttacgtgctttcctgtttctgctgaataatgactgctgtacatcaattgataaaagccgcaggtttttgtctgatctgacagatggaaaaataaacatatcaaaaggcatgatcaataatctctgccggtcatttgcccaaaaaacagaatcccagcgtaaagagattttctgcgacatgctgctttcccctgtcatgcatacagactgtaccaatgcccgtgtaaatggggaaagttcgtatgtatttgtatgtgcggttccggatggcggtgtgctctattttgccaggggcaaaaagggacacgatggaataaagggcacggtcgttgaagactatcaggggacactggtccacgatcatgatgtaaccttttataagtatggaaccggccaccaggaatgccttgcacatgtactgcgttatctgaaagacagcatggacaacgaaaaggaccgtacctggaacaggcagatgcattccctgatacaggaaatgatccattaccggaatggtttatctgaatcagaagagccagatccgcagaccgtctccgaatttgaagaacgttataaaacaatcctgtccatagctggggatgaatacgactatgagccgcctgggaaatactaccgtgatggatacaacctgtacaaaaggatgaaaaagtataagaaagatcatcttcttttcctccataataagaatgtacctgccacgaataacgaagccgaacggctgctgagaaaatataaaagaaaacaggcgcaggctgtgtcattccggagtccgtcaagcatcgaccatctctgtaaatgcatgagcatgctggttttgatgcgcagaaaagagcagaccaatctgttccgcgagattgcagaaatatttgcataagaaaaccgatggttttgactacgattagtctataccatcggttcttttgttacaagtttacctctgaacagtaacttttttagtttgcgcgccatgggcgcactctaacgggtgcaagtcccgaacacgcccagatagtgggaagtgtatagctgaacagcaaatatcggagatttaaggcagaagaattatcggaaactgacattgcatggatctttgatcaggagtattttgagcatccgcagtgtctgaaaatgtataaatggaagcggggatcaaaataaattcccgaaactaaaactacagatataatgaaaaaatatggaggcaagtgaaatgaatattcgaagagcaaacgaaaaagatatcccaagactgattgaattattagagcaggtgcttcaaatccatgcagatataagaccggatatttttattccggggacgacaaagtacacagaggatgaactgaaagaaatgttaaaagatgatacaaagcctgtttatgtagctgcagatgagaatgacgtatgcttaggatatgctttctgccagttgaaacagcagccattctccaataatatggtgccgtttacatcgctttttatcgatgatctgtgcgtcgatgcaaaaaccagaggacagcatgtaggtgagagcctgtttgaatatgtaaagggcgaagcgaaacggttaggctgttatgaagtgacattaaatgtctgggcaggaaatacctccgcggaaaaattctatgaaaaaatgggattaaaaaccaaagagagacagatggaatatatattgtagaaaatgaaaaatgggagattcatatgtgtttgcaggagattaaagatgaaataattgacgctggaaaagaaagtgtattggaaaatatggtgagtctttatctgcatgaattgtctgaaaaagaagaaattttagatggttacgaagtttatacgcagctattttgtgtataagattttttgttgagcacacctatgaagctgtcccccctggcagcagagcagttacagatcccgttcccgtggcacggaaaccatgtttcttctggtgtatgaggtcacggatgagatgtcaaagtattgtattagctggattgggggtgaagataaaaaatgggtgaaatatgaggaaaataaaagtggttcgcccgatttataatagaaatttatcagatataaaagagaatgggcgaaaagtgatggaattcatttcaatagcccacggaaatcaaaaagtcagggcgaaaaacagcagaaatgaagaagattcccccaaaatgcctgtggaaacgctgaaatgaggaagaaagagggcgaaaatgtctgaaaaaatcggattttcgccctgccatctgtttaaaattatctcacgatcgtatcccggatctggtcgagtgacacctcatagttatggccggcagaaatggcttttaaatcttcaaactctgctttctctttttcgacaccgtacccgctgctttttttgatccgtatatcgccgtatgcggaatggcaggtttcgatttcagaggtaagtttggcgcggtcaaacatctgatagcgcacaccgcgtgttgaggtgtgtaaaaagaaaagggaagtcagacgttcacggtcttttggctcacagatacaggttaaaagaatacccggacggttctttttcatctgaatcggtattgtgtatacgtccaaagcgcccgcctgtaagagcagttcagttgcaaatccgaccgcttcgcctgtcatatcatcgagattgcaggagatggacagcacggagtcatcaaaggatggggctgtgttggaaccgggagaagattcgccgaggaaaacacgcacacagttggcggcagcaaaatcctttgttcccataccatagccgatctctgttacattcataggcggcatggcttcgaaagaggtcacaaaatgttttaaaacagcagcccccgttggcgtacagagttcgccctgaatatttctactgtaaaaaggaatcccttttaaaagttctgcggtggcaggtgccggaaccgggagtgtgccgtgggcacagtgtacaaagccatttccgacatgaaccggagagcagagaatggtttccggttcaagcagtgataacagataggcacatccggtcacatccacaagcgcgtcaatcgatccgacttcgtggaaatggatctggtctaaggtggagtggtgcacttttgattctgcttccccgatcagacggtagactgcggctacggagtcttttaccgatgatgggaatggaagtgtgtggatctgttctaagatctgggtgtaactggtatgggcatgcgtgtggtggtgttcatggtgcgagttgttgtcgtgagtatgtgtgtgctcattttcgtcatgaatatgatcgtgaacatgcatgagtgtatcctcgtcatgagagtgtccatgtgaatgcatgagtgtatcttcatcatgagtgtgctcatgtgaatgcatgagtgtatcctcgtcatgagtgtgttcatgtgaatgcatgagtgtatcttcatcatgaacgtgttcatggcagcattgtgtaccatgatcgtgtgtaggggattcttcctgtgcatggattgtcatgtgcccatcttcatgaatgtgctcaggcagaacatcatgggaatgttcttcctcaccgtgtacagctaccctcatgtgtgtgccgctgatcccgcattttactgccggttccacagaaagtgtcacaccgtaaggtgcaaaagcctgattcatgtccgataaaaatttttctttctgatcacagagttcatagagggcgcccattaacatatcgccggcaacacccatattacattctatataaagtgttttcataaataatcctccctggtgctgaatttgatattttttaatatgaagatttacagtttgtccgtgtttttatggcaggatgatggtctgtcatctgttttaggggctgcctgatgattgatcatgctggcaaggtaacctgcaccaaaaccgttgtcgatgtttacgacggaaacaccgctggcgcaggaattaagcatcgataaaagtgctgagataccaccaaaacttgcgccgtaaccaacgctcgtcgggacgccgatgacaggacagtcggtcaggccgccgatgacgctcgcaagcgcgccttccatcccggcgactgcaatgatcgcatttgcctttgataaaagttccatatttgagagcagacggtggagcccggcaacgccgacatcgtagagacggatgacatgattgccgagtacctctgcagtcagcgcagcctcctctgcaaccgggatatcgcttgtccctccggtggcgacaacgatcgtgccgtcagcggaataatgctcggtgcggtttacgatgccgatttttgacagctcatcgtaaaaaagatcaaaacgttcggacaggtacgccgcggattctgtcgaaagtcttgtgatcaggatattttctttgcagtgggagagcaggctgtttataatgccccccatctgttcttttgtcttagatgcaccgtagatcacctccggcgcaccctgtctgacttcacggtgatgatccaccttggcatatccaagatcctcaaaaggtgccagctttaactggtcataagcatcggaagcagtaagctgccccgattctaactgttctaatatatgtttgatatgatcattttccatagtaatcctcatttctgagcaacttgttgcgaagaggcgacgagaatctcaaattctcgtctgtcatgttttttatgccttgtcatagaagctatttgtttttgctcagaaacaaatagccgtgcgaaaaataagctatcgagcttatttttcacactaatttctccttcattgcaattcactgcctattatactcacatcccaccttatttgcaaaaataaaatgcacacgattctctgggttttggaagaaatagataaaaaatggaaactatttttggtaaattagtttcttgcgggtacgaaaacaagatgatacaatataggaaactcaaataacaaaaatagtttccatgtaatacagaagaaacggagaacatgatggaattaagggagagtattttagagggaaccttaaaggcatttaaccagaaagggttaaaatttaccatggatgatctggctggaatccttggcatgagtaagaaaacgatttataccgtgttccgtgataaggaatcacttttcttagcgatggtagattatctgttcgattcaatcaaagagagcgaaagacaggtgttagagaatgaaaaattatccacacttgaaaaaatccgggcggttttaggtgttttgccggagagttaccgggaagttgatttcagacagctctatctgttgcgggaaaagtatccgaacatctacaaacatgtggaggaacggttagaaaccggctgggagacaacgatttccttattagagcagggaatgaaagagggcgtgatccggccggttaagatcccaatcgtaaaaatgatgctggaggcggcattagagcaatttttccagagagatatcctgatctctaacgggatatcctatcaggatggtctggatgaagtagtcacgatcttagtgcagggaatcgttgcggaagggaagtgaggatgatgcaaaaacgcatttactggaatgacgggtggaaatttaaggaaacatacgaaaatcaaatgagagagacggcttatcaggatgacgcatgggaggatgtcagactgccgcacacttgcaaggagacaccgtttcattattttgatgagagcagttaccagatggtgtgctgctatagaaaacatttttttgcaccggaagaatggaaagatcagaccgtgatcgtgacgtttgaaggcatcgcgcatgaagcacaggtgtttttgaacggggaaaggatcggggagcatcactgtggctacacggcattttccatcgatatcagcaaaaaactgcgaatcggggcagaaaatgtgcttacagtgcgggtggatagcagggagaacttaaacatcccgccgttcgggtatgtgatcgattatatgacttacggcggaatttaccgggaagcctatgtggatctgaaaaatgagacttatctcgcggatatatttctgcacagcgaaataccggaaggtcaaaagccagacgcaaagctgatctctgaaatagaaattaaaaacagtggcaaaaccgatgaaaaaaaggaatttctcatccggcagagtatcagagagcgcggcacagaaaactacagacagatcggtgagagccgggtggcatcagatcgtaagcttttttttccggtgccggatgtaaaactctgggatctggagaatccggtgctctatgaagtcaaaacagaacttttgcaaaatggaaatgtgctggatgaaaatattacgctgtttggattccggactgcagtttttttgcaggacggcttctatttaaatggcaaaaaagtaaagctgcgaggattgaaccgccatcagagttatccatatgtcggctatgcaatgccggaatccatgcagaaacgggatgcagacattttgaaaaatgaactgggcgtaaatgcggtgaggacatcccattatccgcagagccggcattttgtggagcggtgtgatgaactgggacttctggtctttacggaaataccgggctggcagcacatcggggatgaaatctggaaaaaacaggcggtcgaaaacgtaaaagacatggtagagcagtatcggaatcatccgtctgtgatcctgtggggtgtgcggatcaacgaatccggggatgatgacgcattttaccgggaaacaaaccgcgtggcacatgaactggatccaacaagacagactgggggtgtccgggcacataaaaagagcagccttttagaggatgtctatacctacaatgatttcagccacaatgggacaaaccacggatgtgagaaaaaaagtgctgttacgtctgataacagcaaaccgtatctcatcagcgaatataacggacatatgtatccaacgaaaagttacgactgggaggaacaccgtgtgtggcatgccatgcgacatgtaaatgtattagatgcagttgccggggaagcggatattgcaggaagttttggctggtgcatgtttgactacaatacacataaggattttggcagcggcgaccgtatctgttatcacggtgtgatggacatgttccgaaatccgaaacttgcggctgcggtctacacgtgtcagcaggaaaaggagccggtacttgaaatcagttcgtccatggatatcggggaacatccgggctgtaaccgcggaacgatctggatttttaccaatgcggacagtgtacggatgtacaaaaatgaccggtttttaaaggagtataccgcatcagattcgccgtataaaaatctttcacacggtccaatcgcagtggatgactttatcggggatgccattgaaaaagaggaagattttaaaccggagcaggcaaggaaagtgaagtatatcctgaatgcggcggcgcggtatggactttccaatcttccgaaaggcgtgtatttggcggcgttgaagctgatactcatgtatcacatgaagccgacggatgcagtggctttgtacaaccgttatatcggtgactggggaggtacttcgacaagctaccggtttgaggcagtaaagaatggaaaagtggtaaaagtggtcagaaaagagccggtcacttccatgcatttatccgcggaaccggaccatcaaaacctgacagaacgaaatacttatgaagctgcggaaatccgtatccgtgccctggatcagaacgataatatcgtaagcttttaccaggaaccggttgtactgtcgacggagggaccaatcgccatcattggacctgaaatcatttccctgcagggaggcatgggcggcacttatgtcagaacgaccggggaagaaggcgtcgggattttaaagataaaagcggcacagatggaagagcagagaatactgtttgaagtgaaaaatgacagaaaataaacggtcactgtgttttacaatgtgaaaagaaattttgaaaagaattttaataaacacaaaataaggaaggatgaagtgtaagatgacagaacgatcaaaacagatttttggaaacgacattgcaccgggtgcctataaaaaagcagtccggtcaaagcagaaatttatccgtaaattcggagatgacagcacaaaaatttatccgacctcgattcaggcaaatccgtatatcggaccggagctcggtgtttcagatatccgtgtaggcgaagaaggcacagcggattttaatacggaaaaaggaatcattgtcggaaacatccgtatgggatttggtcattaccgcatttccatggcgatcgcttccgcagcacatgcgctggggtatgaaccgtactggatggatttaaattcctacggacagaccacctgtaccaaagtgatcggtgcgcagaatgatctttactccatgggttcccgtctgtcacagaagagcagactctttaaccgtctggtgtgggagccgatgaactatgagggatttcgcaaactgacctacaatgcagcagatcagaaaaatgcagaattgatggctccggtgtatgcgaatatcccaaaggatatcccggtcgtcgcaacgcatgtgtggccggcgcaggctgcgcttcacgccggaatgaaatatgtggtcaatgcgatcccggacaactggcagatggcgcttcatttagcggaaggcagcattcacacggtgcagacgcactatgcataccaggggtaccgcattttaaacggaatgcaggggaatgatgtgttgaatccgatgccggaagatgctcttttttataccggacattatatcgaccatgagcttgtcagcaatatcgagacggactgcgcagcgagaaaacagagaaaagaggagggaaaaccgatgcgttttctcctgacgatcggcggtgccggtgcacagaaagaaatttttgcagagatcatccgttttttgctgccacagatcaaagaaaagaaagcggcgctttatgtcaatgtcggtgattaccgcaatgtctgggaggaacttttaaaggaaatcccggagatgggacattatgcgaaagaacattttaacgactgggaggatacgaaaaaatttgcggaggatgcgcttaacaaagatgtcatcggaatccacggcttctggcatgaaaatatttttgaagcggtatactgcacgaatcttctgatgcgaagctgcgatgtgctcgtcacaaagccgagtgaactttcattttatccggtgccgaaactatttatcagacgtgttggaggacacgagcagtggggagcaatccattccgcggagatcggtgatggcacattagagtgcagggatatcccgcacacgcttcagatgatgaaactgtttctggaagaaaagacactgctctgcgatatgtgcgacaacattgtaaaaaataaagaagccggaatctacgacggggcgtataaggtcgtggaacttgcattttcgatgaagcagaaaaaattttaggaaggaaaaaaatcctctgctcgccagaggactcgcattttccttcggaaaacaagggaggaaaatcctctgctcgtcagaggactcgcatttttctccgaaaaacaagggaggaaaatcctctgctcgccagagggctcgcatttttctccgaaaaacaagggaggaaaatcctctgctcgccagagggctcgcattttccttcggaaaacaaggaggatttatgaaattaacaggaaaagagaaagtctcatacggacttggggcggtcggaaaagatatggtttatatgttttcggcaagttatgttttatattattatcaggatattttaggagtcagcgcgatcgcaatgggaatcattctgatggcggcgcgtgtgtttgatgcatttaacgatccgatcatgggtgtggtcgttgcaaagacgcgcacaaaatggggcaaattccgcccgtggctgtttatcgggacactgacaaatgcagtgattttgtatctgatgtttgcggcaccgccaaaactcgatggaaacggactggtggcatatgcggcagtgacttacattttgtggggtgttacctataccatgatggatatcccatactggtcgatgatcccggcttttacggagggcggaaaagagagagaaggactttccacactcgcgcgctcctgcgccggagtcggttctgcgatcgtgacgatcatcacaatgaaatgtgtctatatgttagggcagggaaatgagcgagtcggtttcaaatggtttgcgttggtggttgcaattctgttttttgtatttattttaatcacctgtttaaatatcaaagaaaaatctaccgtggatgtggaggcaccttcggttggacagatgttccgttccctgttacagaacgatcaggcgatgacggtcgttgtgacaatcgttttgatcaactgctcgatttacattacatccaatctcgtcatttattttttcaagtatgactttggcggtgatagctggtacaatgcctataccttatttaatacgtttggtggagcaatgcagattcttgccatgatgctgtttttcccgatcctgcgcaaatttctgggaacgatccaggtgttttataccagttttgtgatggcgattttaggatatgcggttcttctgattttaatgtttgtcaatatgtcaaacctgtatctgctgtttgttcctgcattttttatcttttcagcaaatggaatgttatccgttctcacaacggtattccttgcgaatacggtcgattacggagagtggaagaatcacagaagggatgagagcgtgatcttttccatgcagactttcgttgtaaaacttgcttccggtgtggctgcgcttgtggcatcgatctgcctgaccgtctgcaatttaagccagaatacggacggagcagcagttgcggcagcgggaagttcggtcgcaggactgcgcctgaccatgacagtattcccgatcgcaggactgcttgttgcggtattttatttccgcaaaaaatatattttaagtgagcagaaagtggaagaaatcgcaaaagagattaaggagatgaaaaaagcatgatcacagtcgaaaaccagttattttccctgcataccagacatacttcttatctgttccgtgtcatggaaaccggacatttggagcacttatattatggaagaaaaattcatccagccatagacggattgatggaacagcatgcatttgcgccgggcaataccaatatttatgacagtgaacatctgcagttttccttagaggacgcatgtcttgagatgtcctctttcgggaaaggcgatatcagggagccttttgtggaactgacactttccgatggaagcgaaacgtctgatttcctgtttgaaaaatttgaacagggaaccggaaaggaagaatttgagacacttccgggatcgtatgatgagtccggtgaggtggagtggcttggtgtgacactgcgcgataaaaacagcggagtcatattagaactccattattatgtctatgaggactgtgatgtgatcacaaggagcgcaaaactcatcaatgagagcggggatgtggtaaagttaaaccgcctgatgagcctgcagcttgatttagaaccgtccgactatgtgtttacaacatttcacggggcttgggcacgtgaaatggggcgcacggacgtacggctggtgccgggaaaatatgtaaacgcctcttacacgggaacgtcatcgagccgtgacaatccgtttgtgatgcttggaaaagaacataccacggaggatacgggggaatgttttggatttaatctgatctacagcggcaatcactatgaggcggcggaggtcggcagttttggaaaagtaagaatcgtatccgggatcaatccgcagtcgttctgttttacacttgagtcaggggagagttttgaggcaccggaggcggtaatgacctacgcatcagacggatataatgccatgagccagaatatgcaccgttttgtgcgggagcacattgtgaggggaacctggaagaaaaaggagcgcccggtgctcttaaacagctgggaggcagcctattttgacattaatgaaagaaaactgctctcacttgcaaaagcgggaaaagaggcgggcattgagcttttcgtcatggatgacggctggtttgcaaaacgtgataatgacacgagatcgttaggagactggcagccaaatccaaagaaactgccgggcggtttaaaggggattgcagataagatcagggcgattggcatggattttggaatctgggtggagcctgagatggtcaatgtggacagtgatctctaccgcagccatccggactgggtgatcgagattccgggaaaggcgcactcggaagggcgcaatcagaggatccttgatctgaccagaaagaacgtgcaggatcatatcattgaggagatgggcagagtattttcctccgcggacatttcctatgtaaaatgggatatgaaccgcacattttcggattatttttcacagagtatccgtcctgaaaggcagggggaggtggcacaccggtatgtgatgggactttaccgctgcatgagggagctgacaaagagattcccggacatcctgtttgagggctgtgctgcgggtggaaaccgttttgaccttggtatgctctgttatttcccacagatctgggcgagcgatgatacagatgcgctctgccgtgccgagatccagaccgggtacagctacggctacccgatgtccgtgataagcgcacatgtctccggctgcccaaatcatcagacactgcgcacgacaccgcttgaaacacgttttgcggtagcggcgtttggactgctcggatatgagtgcaatttctgtgatctgaaaaaagaagagtcagaagccatcaaagcgcagatcattctttacaaaaaatggcgcagtgtgctgcaacagggaattttttaccgtggcaggagttttacagggaacggcagaggaaatgcgtttggaaaaaacagtgtcctctggaatgatgacagcaatgtgacggaatggacgtgcgtctcgccggatcagtcgaaggcggtcggcttcgtcatgcaaaagcttgtcgtgccaaacacgcagttcgggtactataaaccacagggactctgtgaggaaaagaagtatcatttttataaccgttctttaaaatataatgtcaaagagttcggggatctggttaacaccgtatcaccgatccatatcagacaggactccattgcgcacaatctggttgcaaagtttgtgaaaatggacggggaaaaggagaatattacggcatacggggataccctgatgtatggcggcgtgaagttgaaaccggcattttctggcaatggatataatgagaatgtgagatattttcaggatttcggggcgcggatgtattttatggaagaggattttgaagatcatgctctatgattttggttcgtcgatcttaaggggcatcggggacagtgagcgtccgctttacagcctgatcgctgcggtatgtaagagagtgcacgaattctgggtgctgatgatcatttacccgatttcgtgggttgtgacgggaattgcgatgatgatcccgtatacgttgctgcggagaaagattttggcaaaaagtggtgtaaatcagcttgaataaaaaaatataaggggaaaaaatgtcttatatcatatcctacgtcggagccggcggaaagaccagcagcatttatcaggatgctgcagcgtttgtaaacgaggggaaaaaagtcatgatcacaactacaacgcatatgtatgtgccaaaagacctggtgttcattgatggcagggagaaaagttgtgagaagctgcgagagaaagtagccgggattttgaaaaaaaaagggatctgtgtgtgtggcacaattttaagtgataataaaaaaacagagatttatgcggttggaaaatgtgccggaaacgatgctgttgaagaacagcagaagatggaaccggagaagtttaaaactttaagcattaaacagcttacagcagtatgcaaagaggcagatgttgtcctgatcgaggcggacggcgctgcacataaggcggcaaaagcgccggaagcatgggagccggcggtgtatgcacagagcaataaagttgtgatcgtcatgggacttcacgcagtcggaggaagtgtggatgaagtgtgccacagaccagagtgcgtaaaggaagcattagactgcgacggagcgcatcttttgacgcgtacggatttggatgtactgatggcggtctatgaaaaaaagatcggacagcagtttccggggatggagacggagcggagatattttataaaaagttcttgacactaccgctttaccatgctaaaatcgaaacaacttaaaaaacaaagaaacgttaaatcgttgagcaaagagagtacttcataggatatctcacagagagtccgtggctggtggaaacggacagatgaatatgaaaggaatgggtttgcgagagcaaagcgaacagcgtaccagatggtatggtcagtagcggatgccgtgtcctcacgttacagaggtaagatatcggacagtaaagaaagatagctgtttgtgtgtcggatgaggtcagacatgattggtggcggatatttccagtttttggaaatatccgtttttttcattcataggaaattacgtcctatgaatgaaaaagccctccgggcgggatgcgcaccttgcggagatgaagtttgctgtaaacagcaccgctcgggcgcgaaagagtcgcaagcgactctttgtcctacatggaatcataatgtctggcgaaacagggtggcaccgcgtgaaaacgcccctgactggaaaaaaattccggtcaggggcgttttttaacaataaaattcgcgcagagtgtgaactttattgttttgataacatggttttgcaacaggtgattcgagaatggagattgggatgaaaagaatttacagagtttacaaaaagacagtcagtattgtaaatgagacagcaaccgggatgtaccggaatctggtggcaaagaaaaaaggatttttgttagagagttatgacaagaattatgaccgctatacatttttcggcgtagaaccggaagagatcatttcctcgaagggacagtcaatggtgattacaaaaaaagatggtaccgaggatgtcagggagggaaatccgcttacattattaaaagaatattataacgaatttgaaattcggaaggacaatgaggaactgaatttttcgggaggtcttgtgggaagtgttggttatgacttcgtgagatacagtgaggtgctgccggaagaaaacccggatgagatcgggattgagacggttcagcttatgctgatgaaagaattcattgtggttgatcatgtggcagaaacactgaccgcggtgatcttagaatccgatgatgagacaggaaaagaaacggcagcgaaaaaagcagcagaattgatcaaaactgccatgcaggaacagaaagaatcagaagtaagactgtttccggatggagtgatcacgaaaaagtcagatactttagaggaatacagtgaaaaggtaaataagatcaaacagtatatccgcgacgggcatattttccagaccgtgttatcacagcgctggacgatcgcgacgggacaggatggatttgatctgtactgcgaactccgtgagctaaacccatctccatatctttattattttaattttggagattttgaagtgattggaagttccccggagatgctggtcaaacaacaggggaataaggtatttacctgcccgatcgccggaacaagaccaaggggaaagacaaaggaagaagatgacagactgcacagggaattgcttgccgatgaaaaagaacgtgccgaacatgtcatgttagttgatctggcccgcaatgatatgggacgcatctcagagtttggtacggtaaaagttacagactttatgagcgtaaaaaattattcacatgtcatgcatatcgtctcgatggtcgagggacgcaagaaaggcagttttcacccgtttgatctgctggcatccttcctcccggcaggaactttgagcggagcaccaaagatcagggcgatggagattatcgaagaactggagagtgtgagaagaggcctttacggtggtgcaaccggatatgtggatttttccggcgatatggatttctgtatcacgatccgtacgatgatcaaaaaaggaaaaaacgtttatttacaggcaggagctggaatcgttgcagattctgttccggaaaatgaatacaaagaatgttgtaacaaggtcatggctctggcaaaaacccttgtggaggaggaaaacttatgatattgctgatcgataactacgattcatttacatttaatctgtaccaatatattggaacttttacgcaggatataaaggttgtccgcaatgataagattacgatcggggagataagagagttacatccggataaaattgttctttccccaggaccgaaaagtccgaaggaagcaggaatctgtatggatgtggtaaaggaattttacagagagattccaatccttggcatctgccttggacatcagtgtatcggtgaggcatttgggggaaccgtgacatacgcaaaagcattgttccatggaaaacagtcagagatcacacataccggaaccggaattttcgcaggaattacctcaccggtcaaggtggcaagatatcactcgctggcagtgcagatggatgatctgccggaatgtctgacggttatggcacagaccaaagacggagagatcatggcaatgcagcataaagaatatccggtgatcggtttacagtttcatccggaatctatctatacagaacatggaaaacgaatggtggaaaattttatcaatggaatcaattaggaggtagttatgatactcgatgtcattgtagaggataaaaagaagcgtctgccggaacataaaaagaatatcagtgaaataaaaatgcgtgaactggcagagaagtatgaaggcaaaaaacacggtttttatcaggcattaagtaaaagtggtatttccattatcggagaatttaaaaatgcttccccaagtcttgggaaaattaaaagtaaaataaatttattggacagaattgatgaatacaacgaatcggtagacgcaatttcctgcctgaccgaggaagatcattttgatggaaatgtggactatctgaaaaagataaggacgatcacggagctcccaatcttaagaaaagattttatgatcgatccctaccagttttatgaggcaaaggcgattggggcagatgcagtacttttgatcgcagcaattttagatgatgcacagatgaaagatttttatcagttatcgaaagaattagagctggatgcactggtggaagtacacgatgagaaagaactggagcgggcaatgaagatcgatgcagatatcattggagtcaacaaccgcaacctcaaagattttacaatcagtctcgatacgacggtacagctttcgaaactggtaccggaagacaaagttttggttgcggagagtggtatcttacaggatgcggacgtggaacttttaaaggaatgtggtgtggatgcattcctgatcggcagggcactgatggaagcggagcatccgaaggaggttgcaaagaggtggaaagcataaaacagaaagttccacagatcaaaatctgtgggatcacgcaggatgaggaaatacaatggctgaatgaagcggatgtttcctatgcaggatttgttttatatgaaaaaagctgccgttacattccaatcagtaaaacacaagaattgtttggaaaattaaatgacagtataaaaaaggtagctgtcgcagtaaacccggatgtgacgatggtaaaacaagttatggatgcggggtttgatattctgcaggtgcatggcaatctgacagaggaagtcctcgcagtgacagagatcccggtctggcgggcggtcaatcttacggatgcgaatatatttgagaaactagtgagggaatatagagatttatccatagatgaaaaaatcacggcacttctcatggatgccaaagagtttggaagcggaaaaacctttggatgggatgcatatgagagagacgagggcaaagaaatgctaaggcagttacgacagatacttgagaaagaacaaatccagtttgtacttgcaggaggtcttaccccggataacgtcagccgggggatagatattttttcaccggatatcgtggatgtcagttcgggtgtggaaaaagaacctggacagggaaccggaaaagacagggaaaaaatacagaaatttgtgcggaacatgcattctattgtttagacggcggaaaatcagaaatataacagtatttcgttatagaaagtgataaataaagcaaaagagatataagttaattttaaatttaagaaaggaatacaaaaattatgaaccagaaagcatattacggagaatttggaggacagtatgtagcggaatctctgatgaatacattagaggaattagacaaagcatttgaggaggcaatccatgatccggaatttatggagcagtaccattactatttaaaacagtatgtgggacgcgagacacctctttactttgcggaacgtctcagtgaaaagtatggcacaaagatttatttaaaacgtgaggatttaaaccataccggagcacataagatcaataatgtaattggtcagatcctccttgcaaagcgtatgggaaaaaagaaagttattgcggagaccggtgccggacagcacggcgtggcaactgcgacaggtgcagctttgtttgacatggaatgtaccgtttacatgggcgaggaagatatcaggcgacaggcactgaatgttatgagaatggagatgttaggggcaaaagtcgtaagtgtccgttccggcagtaatacattaaaggatgccaccaacgaggcaatccgtacctgggcaaagacagcggaagataccttttatatcatcggttctgcggtaggtccatatccttatccaaagatggtcagggaatttcagagcgtgatcagcagagaagcaaaaaaacagttcttagaagtggaacacaggctgccggatgccgtgatggcatgcgtgggcggcggctcgaactccattggaatgtttgcagattttatagaggaaccttcggtaaaactgatcggcgttgaggcggccggaaagggaatcgagacaggtgagcatgcgtcggcgatggcacttggtgagccgggagtcttacatggcatgcgttcctatctgctgcaggatgaagatggaaatgtaaaactggcacactctatttccgcaggactggattatccgggggtcggaccggagcacgcctatctcagagacagcggaagagccacatatgtttccgtgaccgatacagaggcaatggatgcgctgatggaactctgtaaattagaaggaatcattcctgcgattgagagcgcacatgcagtagcttatgcgagcaaatatgcgaaagaacttaccgaaaaacttggtgcagcggaagcaaaggataagacaatgatcatctgtctgtcaggacgtggagataaggatgtcaatacgattgcggattatctgtcaggaaaaggctacctgaactgattcagaaaaaataaattaaaataatataaacatgatttaataaacgaaaagaagggaaagacagatatgaatcgtattgaagcaaaaatgaaagccttacaggaaaaaggcgaaaaagcatttatcacttatattacagcaggacttccggatcttgagggaacaaagaaactgctaaaggcgcaggaggaggccggacttgacgttgtggaacttgggatcccgttttctgatcctgttgcagatggtccggtcattcaggatgcatcctacaaagcaatctgtaacggcatcaatttaaaaaaagtatttgtgacagtagaggagctgagaaaagaaggttcagagcttccaatcgtctttatgatgtattacaacaccatacttcattatggggtagaggcatttgtgaaaaaatgtaacgaggtcggtgtggatggtcttattatcccggatctgccgcttgaggaacaggaagaaatcgcaaaatacttaaatcaggatgaaacaactattctgattcagcttgtttcaccagtttccggtgaccgtattccaaagatattagatggcgcaaaagggtttgtatactgcgtatcttctatgggtgtaaccgggcagggagcagatttccacaaagaagttttaagttatctgaagagcgtgaaggctgtcgcaaagattccggtcatgatgggatttggtatccgcacagcggaggatgtaaaaccgatgaaagatacgatcgacggtgcaatcgtgggaagccatttcatccgtctgatggaagaaaatgattatagcataaaagtggcagcagagtattgcagtacatttaagaaagaattaaatcaactttaaataaaaatagggaggaaaatcatgcacagcatgctgggcattgctcctgcaagaggcaaatgctataaaaaacatagcatgtattttgctccgcaaaacaaggaggattatcatgaaagaatacatagcaaaagcagtagatggaaaaaatttaacacaggaagaagcaaaaaaagcaatggagatcatgttaagcggagaggcaacgcaggcacagatcgcagcatttttaacggcaatgcgcatgaaaggagaaacgttagaggaactcataggtctggcatcggtgctgcgcgataaggcggagacaatcacaccgaaatctgaaaactatgtggatctggtcggaaccggtggagactgtacctatacattcaatatttcaaccacatctgcgtttgtggtcgcagcggcaggacttccggttgcaaagcatggcaaccgttccatctcctcaaaatccggtgcgggtgatgtgttagaggcacttggagtcaacattatggcagaaccggcactggtacagaaatgtgttgatgagaccggaataggttttatgtttgcacagcttttcaataaatccatgaaatacgttggccaggtgagaaaagagctgggaatccgtacggtatttaacatcttaggacctcttgcaaatccgtcccgtgcaaaaaatatggtcgttggtgtatacagtccggcattgacggagaaaatagcaaaagctatgggcagacttggggtggagcgcggatttgtcatcagtggaaatgataatatggatgaatttacgttaagcggaacgaccacagtatcagagattgatggggaaaatgtaaaaacctatgaggtaacaccggagcagtttggattaaagagagcttccttagaggaattgcgcggtggagacggtgcacagaatgccgagataacgaaagctattttaagcggaaaagaaacaggagcaaaacgtgagattgttcttttgaatgccggagcaactctttatatcggaggggttgcagaatccatagaatctggtgtaaaattagcggcagaaaccatcgactccggaaaagcaatgaaaaaacttgaggaattagtcagagtttcaaattcatagaaaagcacgaaaagtgcaggaatggagaaaataatgatacgatttaacagcgattatacggaaggatgccatccggcaattttaagaagactcgaagagacaaacatggaacagacggcgggatatggagaggatgaatattgcagggaggcggcagaacggataaaagctgtctgcgaagcaccggatgccaatgtacattttctggttgggggaacacagaccaatgtcacagtgatcgcatctgcattaagaccctatcagggagccatcactgcgacgaccggacatatcaatgtgcacgagaccggggcagttgaggcgtgcggatataaatgcctgacgatcgatacgccggatggaaagctgacggcagagcaggttgaaaaatatacaaaagcacattttgcagatgagagttttgaacatatggtacagccgaaactcgtgtatatttccaatccgacggaacttggaaccatctataaaaaggcagaacttgaggcgttataccgggtttgcagggaaaacgatctgtatctgtttttagacggagcgagacttggatacggacttgcatgccgggaaaatgatctgacgatggcagatattgctgcgaatacggatgttttttatataggaggaaccaaggtaggtgctttgtttggtgaggcagtcgtgatcaccaatcctgaactgaaaaaagatttccgttatagcatcaagcagcgtggcggtatgctggcaaaaggaagattgttaggaattcagtttctgactttatttgaggagaaccattattttgaaatatcagcacatgcagcacgacttgcagaaaaattaaaagatgaattaacaaaaatgaacatttcgttctatatcaattccccgacaaaccagcagttcccgattttgccggatgatgtattagacaagctgcgggaaaaatacagctttgcatatcaggcaagggtggatgaaacacacagtgcagtgcgtttctgtacctgctgggcaacaaaagaagaaaatgttgaagcacttcttacagacataagagcaatcatatagaaatggagattaccggtatgtcggcaaagaaaaaaatattattacttgcaacagggggtacgattgcttctaaaaagtctgagaatggattaaagccacagatcacaccggaagaactgttagagtatattccgcaggtaaaagaattttgtgaggtatctgcaatacagcttttgaatctcgacagttctaatatggaaccggaacattggaaaaaaattgtacatgcaatccgggaatattatgacgcttatgatggatttgtcattgcacatggcacggatacaatggcatatacagctgctgcactttcttatatgatccagaattcaacaaagccgatcgtgatcacgggagcacaaaaaccgatcgaccttgaaattacggatgcaaaatcaaatctgatcgacagttttttatatgcggcagatgaaaaatcacagggcgtgcagattgttttcgatggcaaagtcattgcgggaacgcgtgcaaaaaaagtaagatcgaaaagctataatgctttttcaagcattgattttccgtcactggcagtgattcaggatggcaatatcatgcgttatctgccgatgctcccatatgaggatgaagtacggttctatgaggaacttgacgagaacattttcctgatgaaactgatccccggtatccgtccgcgggtgttacagagtatttttgaaaattatgactgtattatagtggaaagttttggtgtgggcggtattccaaaatccatagcggatgagttttaccgtctgtgcagacagtacccggacaaactggtagtcatggcaacacaggtggcacacgagggtagtgatatgaccgtatatgaggtcgggcacgatatgaaaaagtactgtcgtttcttagaatcttatgatatgacacttgaatcggtcatcgcaaagacaatgtggatgcttggaaattttgatctgcacagcatagatgtggaggacattttctaccgcagcattaattatgatgtgatttttggaaaaaacagaaaatgttaaaacagattgtaaacaaaagtgaaatatccagttgacaataggaaagaatcggactagactgtaaaaaaacaaatgcggaaacatttttttcgcagaaaagaggagaaaatgaaaatttctacaaaaacaatcgttaccgttgggatgtttactgcagtcctcgcagttctttccattcttcagattccgatgccgaccggtgtgccgatcaccctgcagacttttgcaatggcattgtgcggttatgtgttaggatggcagtctggagtggcagcaacattactttatattgtacttggaactgttggtgtaccgatttttgcgggaatgagtgcaggaccgggagtgctgtttggctataccggtggatttatttttggatttatttttctgacattgttatgtggcatttctgtccgcagaaaaaatccggcggtaaagatcatccttggagtaatcggtcttttgatctgtcatctgcttggtgctgttcagtatgcagttttggcgcatattactattggagcatctttagtggcagtgtcactgccttatattgtaaaagatgtgatttcagtggttggtgcttatctggttgccattgctgtccgtaaggcgctttatgcaggaaatattttacaggatgcaaaggcagcttaaaggtggcatatctatgaaaaaatttcgtgtgcaccatattttgtgtaccgtcctttaccggggagagggatacagtggcaccttctgtgacaatatgacacagaaggtgcgggaactgaaggcagacccggaagaaccgctcatgctcgtgacagacccggatatgatctgtgcgcgctgtccgaaccggacaccggatgatacctgtgtggatgataaaaatcatgtaaaatcaaaagatctggagctgttagaactgttcggattaaaagaaaatcagctttattcttacagggaactgctgcagtgtgcagaaaaaaagcttgataaggaaaactttttaaaaagctgtggacgatgcagatggtatcagcagggattgtgcagttatgaagaatggctcgaaaatgccagaaaaatcttaaattttcttaaagaattttagaatcagatctgcaaacagtatattagtatcagtatagagacttcagcataagtatgctgaagtcttttgcttaacagggttctttcctggataaacggtatgaaaaatatgcctgacaagggaaatcaatattttattccgttttcttgttaatataattcgtcttatactttgagtaaatgatcttctggctgtggtagagtccgaaataaccggaaagcatgtagctgaaagcaactgccagtaaaaagtatggcattccgtcataaccgaacagctcaaaactgatcaaaagagaagtgatcggacagttagttacaccgcagaatacagcagccatgccgacagcggtgcagagtgcaggcgaaaagccgagcaggtttccgaacagacatccaaacgctgcacccgtgaaaaacgaaggcacgatctcgccgcctttgtagccggcgccaagcgtggcagctgtaaagatcattttcagtaaaaatgcttccgggcgcacggtgccgtcgatgcactgtgcgatgatattgacgcctgttccgttgtaattctggttaccgacaagcagtgtcagcacgatcacgatacatccaccaacgaaaacctttacataaggattcttgaaaaaatgtttataaagcgcttcggactggtgcagcatcacgcagaacaggatactgataccggcgcagagaattgccagcacggagatgcggacggcgttgccgattccgaaggagggaatcgaatcaatgagaaaaagttcctgcgaaatcccaaaagaaacggcaatcccatgcgcaacaagggaagagattacgcatggaaccagtgcagcgtaatacatgatgccgacacttacaacttccatggagaaaatagcagcagccataggtgtgccaaacaatgcggagaaacaggcactcatgccgcacatgatcataatatgcttgtccttgtcgtcaaaatgaaacagtttaccaattccgttaccgatgcttccgccaagctgcaaagcagcaccctcacggcctgcagatccgccaaacaaatgggtgatcagtgtggaaataaagatcagtggtgccatcttaagcggcagattatcgtcggaatggatcgcagaaatcacgagattggtaccggtgtcatgctcgtcgtgaagcagacggtaacagccgacgatcacaagaccgccaaaaggaagcagaaagatcagccatggatgtttggtgcggatcagtgtgactaacgtcatgccaaaataaaataatgttccggcgcctccggcaacaacaccggagataattgcaaacagaacccatttaatagaagtttcaatgcgttttaaattgtgttttattttatgtctgatgatttctttcatatctgtaaactccattttcataaacttataagtttaaatttctaacaaaatcttagcattttccagctttttttacaatataaatcagtaacaagtgcaatgtgcacaaaaaacggatgcaatatttggataaaacattgaaaatgtcaaaagagtcttgcgcttttgcaaagagtgtcttataatttaaccatcaaatgaaaacgttaccggtagcattaccgtaaacaataccggaaacgttccataagataccatacacaatttcaggagggtaaaaaatatgaaaagaaaagttttatcagtgatgttagcatccgctatgttagcaaccatgtttgcaggatgtggtaacggaaatgcggggaatacttccggaacagcaaatgcaggaaacaagacagaagaggctgcaaagacagaagaggctgcaaagacaaccgaggcatctgatgcagaaaagactgcagacagtgcatcaggaagcggttctgtatattatctgaacttcaaaccggagcaggatcaggcatggcaggatttagcaggtatctatacagagcagacgggtgtgccggtaacagttattaccgcagcagacggtacatatgagcagacattaaaatctgaaatggcaaagagcgaagctcctacattatttcaggtaaatggaccggtaggacttgcaaactggaaagattactgctatgacttatccgacagcgagatctgcaaacagctttccagtgaagattttgcattaaagaatgacgctggtgaggtttccggtgtcgcatatgtgctcgagacatacggtatcatttacaataagaagattttaaatgattactgtaccatggataacgcagtgatttcttctccggatgagatcaacagctttgataaattaaaagcagtggcagatgatattcaggcgagaaaagatgagatcaacagccagttcggatacgatcttcagggtgcatttacatctgcaggtatggatggatcttctgactggagatttaagacacatcttgcaaatcttccaatttactatgaatacaaagacaaaggcatcacaagcacagatgcgattgagggaacataccttgacaattataaacaaatctgggatttatacatcacagattctacctgtgaaccaggtgtcctctccagcaagacaggtgatgaagctgagtcagagttcggtatggaagaagcagtattctatcagaatggtacatgggagtacggcaatctgacaaacgaggataatggatatttagtaacagcagatgatatgggcatgatgccgatttacattggtgctcctggtgaagaaaatcagggactctgcacaggttccgaaaactactggtgtgtaaacaaacaggcttcggaggaagatatccaggcaacacttgatttcttaagctgggtaattaattcggatgaaggacgtgactccatggcgcatgcaatgggattcacaacaccattcttaacatttaccggtgactatgtagctgacaacgtattcattcaggatgcaaaccagtatattgcagatggcaagactcctgtttcatggaacttctcaaccattccttctgagacatggaaagatggcgttggctccgcattacttgagtatgcacagggtaccggtgactgggatgcagttgtaagcgcattcgtagacggctgggcaactgagtatgcagcagcaaacggacagtaaaataataatttctcttttagaaaatagtaaatttgtgcggtatctgtgccgataccgcacaaaccatatataacggaaattttctgaaagaactgtatttagagattgaacggatttatgagaggttaaagactatggagaaatcaataaaaaaatattttccaatttttgcgctcccgactttagtggcatttaccataggttttatagttccttttcttatgggtatctatttatcattttgtgaatttaccacagtaacggatgcgtcctttgttggactgaaaaattacctgcgtgtatttaccgatccaacatttgtacatgcgctgtggtataccgcattatttacagtggtatcagtgattacaatcaatgtatttgcatttaccatagcgatgcttttaacaaagggaattaggggaacaaatgtgttccggaccgtattttttatgccaaacctgatcggaggtatcgttttaggatatatctggcagatccttttaaacggaattctggcaaacttcggaaaaacattgacctattcttcctcatatggtttctggggactgatcgttttgatgaactggcagcagatcggttatatgatgatcatttatattgcgggtatccagaacattccgggtgaactgatcgaggcggcaaagatggatggtgcaaacagctggcagctgttaaagaaagtaacgattccgatggttatgccatccatcacgatctgtacattcctgacactgacgaactcctttaagctgttcgaccagaaccttgcattgacagcaggagagccgtcaaataattcacagatgcttgcgttaaatatctttgatacattttatggaagaaatggatgggaaggtgtcggacaggcgaaagcggtgatcttctttatcatagtggcagttatcgcactggcacagaaccgtctgaccagaagtaaggaggtacagcagtaatggcaaaacagacagacaatcaggtaagtgcagtaaggcgtgcaaaacacggatggatactgacactgtttttcagcattttagctgtattttatctgtatccgatttttttggtgctgatcaactcgttaaagaaaaaaggatttattatgaaaagtccttttgcatttccggatgagcgttctttcttcggtatgacaaactttgtaaagggaattgagaagacgaatttctttgcagcgttcggtaactcggttattatcacggtaggttccgtggcagtgatcatattctgcacatccatgtgtgcatggtttatcaccagagtacataataaatttaccatggcactttacatgttatgtcttttctccatgatcgtgccgttccagatggtaatgttcccgttatctaagctggcaaacatgatgcatttgagcaacccgatcggtattatattagtatatctgggatttggagcagggcttgcggtatttatgttctgtggatttgtaaagagcattccgttagagatcgaggaggccgccatgatcgatggctgtacaccgatccagaccttcttccaggtcgtattcccaatcatgaaaccgacggttatcacggttgcaatcttacaggcaatgtggatctggaatgattatctgctgccgtatctggtacttgacctgaaaaaatataagacaatcccgattgtaatccagtatttaaaaggcggttacggtgcggtagactggggtaccatgatggcgatgctggtactcgcaatcatcccgatcatcattttttatggaatctgtcagaaatatattattgaaggagtagttgcaggagcggtaaaaggctgatatcttattaagaaatgtatattttttgttgaaatttgacaaaaattcaaatttcacgaaaaaatacgaaaaaatagtagacaggaatgaaaaatatggttacgataaaagacatagccagggaatcaggatattccgtcagtaccgtgtcacgtgtgctgaatcacagaaatgatgtcagtccggatgcaaaaaagaaaatcgaaaaagtagtcgcagcgtataattttgtgccaaacaataatgcgaaacatctaaaacagagtaattccaaatccattggtgtgctggtaaaaggtatccaaaatatgctttttgccagcatcgtggaagaaatccagtgtatgattgaaaatacagactatacgctgatcgtatcctatttagatgaggatgcagatgaggtggagcaggcagttctcctctgcagggagagaaagccgcttggactgctctttttaggaggtaatccggagtatttcaaaaaagaatttgcgcaggtcgatgtgccgtgtgtgcttgtgacaaaccttgcagaccagatggattttccaaacctttcttctgttgcgacagacgatattgccgctgcaaaatgtgcagtggatgcgttatttgatgcagggcatacaaaaatcggtattttaggtggtgatattgaaaaatcatacaccagtcatcagcggtttattggctgtcagcagagctttttggaacatgatactgtgtttgtgccggaaaaaagctacgaaaaagcacgattttcctatgacagcgcatatcgcggtatgaaacggctgatcgccaggtgtccggatatcacggctgtgtttgccatgtcggatgtcatggcgatcggtgcgatccgtgcactgcgggatttagaataccgtgtgccggaggatgtgtcagtgattggatttgacggaacagctctggcagaatactataatccgaaacttgcaaccattaaacagcagtatcagacgcttgcaaccagaagtgttgagatcctgtttggacagattgagttaaaaaggagtcagatccatgagatcgtcccgtttgaactggcgagtggagagagtattcaaaaaatcaggtaacacatatagatagtaggaggaacaaatattatgaggaccagcggtgtgctgatgcacatatcttccctgccgtctccttacggaatcggtaccatgggaaaagaagcaagaaaatttgcagattttttgaaaaaggcaggtcagaaatactggcagatcctgccaatctgtccgaccagctacggagattccccgtatcagtctttttccagctttgcaggtaatccttattttattgatttagaatatctttgcaaagaaaaattactgacaaaaaaagaatgtgaatcattttcgtggggaaccaatccgcagtatgtggattatggtcagatgtatatctcacgttatcctttgttaaagaaagcatatgacaggttcaggaaaaatgagccggaagattttgcagcattctgcaaggatgaagcagagtggttggatgaatatgcactttttatggcattaaaagatgctaacggcggtgttgcatggtttgagtgggaaaaagacttaaaaaccagaaaaacggaagccttaaaagaagcgcgggttacctatgcagaagatattgcgttttataaaatgttacagtatctgttctttaaacagtggtgggatttaaaagcgtatgtcaatgatcttggcattgagatcatcggtgacgtgccgatctatgttgccggagacagtgctgatgtctgggcagatccgggacagttttatctcgatgaggagttaaatccgatcgatgtagcaggctgcccgccggatgcattctcggcagacggacagctctggggcaatccgttattccgctgggatgctatgaaaaaagacggttacagctggtggacgaagcgtgtaaaagcgatgtcaaaattatacgatatcgtccgtatcgatcatttccgcggtttcgattcttactatgcgatcccggcaaaagatgatacggcgagaaatggtgagtggagaaaaggtcctggcatggatctgttccgtacgatggagaaaaaactcggaaagttaaatatcatcgtggaggatcttggtttccttacaccttccgttttaaaactggtaaaagattccggattcccgggaatgaaagtcatccagttcgcatttgattcaagagagggcagcgactatctgccgcacaattatgagaaacactgtgttgtttataccggaacacatgacaatgatacgttgatgggctggatgaagacagcaccgaaggcaagtgttaaatttgcgaaagagtacttaaatctcacggaggaagaaggttttaactggggtatgatgcgcgctgcatgggcatcagtcggagatatggcgatcgttccgatgcaggatctgatcggaatcggttccgagggacgtatgaatacaccgtccacactcggcggtaactgggagtggagagcaacttcagaccagatcaccggaaaacttgcaaaacgtctctataaatatatggagatgtatggacgtttaaacaaagatcaggaagaggaagaagaaaccgaagcggaggagaagaaagtatccgcagaggaaaaataacagaccgcatacaggtctgatggcatgaaaaacagaagtttagaggggggattctgaccggtcacaggttagaatcctcctttttatattatgggttcctttttgtcggaaaatgttttaaaataacaaataatcgaaagcttatatggggggatacatgctatattttattgtcaatgaaaagtcaaaaagtgggaacgcaaagcagatctggaaagagatcgaggaagtgcttaaggtgagaaatgtttcctatcaggcatttgtatcggagtaccgtggacatgccggtaaactcgctgcagagatctgtgccatggatgacaatgatatctgcctggtcgcagtcggtggggatggaacggcaaatgaggtgatcaatgggatcacggattttgaaaaggtacgtttcggcgtgatcccgaccggttccggcaatgatcttgccagaggattgttactctcgaaggatccgaaaaacggtgccatacatattttaaatgcgatgaaaaaatcgcgtgaggatacctggtgtatggatttgggagaggtgaactttggggaggaaaaaagactgtttgccatcagcgcggggattggactggatgcgttagtctgtaaaaaagcattaaaatcaacgatcaaagatatcctgaataaaatccggcttggaaaactgacgtatctggtactgaccgtgcagtcattatttacgatgcagaccgcggatgcagagatcttttttgaccgggaggaaggtttacagaaaaaaagaatgatctttacggctgcgatgaattttaaagctgagggaggcggtgtgccgatggctccggcagcatccgcctgtgacgggaaattatcattctgtgaagcagcggggatcccgaagtggagaacatttctatgtctgccgtttttagtggcggcaaagcatacgtctatccatggattttctgtgacggatgccaaagactgtacgatccgtttaagccgtccgatggttgtccatgcagacggggagtactgtggggaagtgacggaagttcatttccactgtctgccgggaaaacttcgcgtgttaaaataatgaaattgcggacactgccgtcataaacaggcgttcttcttcataaaatgttacaacatatggaggagaatatctgatggaacatttcagtgataacagggaatttgacttataccgggatatcaatacccgtaccaatggagagatctacataggagttgtggggccggtgcgaaccggaaagtccacatttattaaacggtttatggatcttatggtgcttccgtttatggaggatgagcatgcgcgggagcgcactatagacgagttgccacaatccgcggctgggaaaacgatcatgacaacggaaccgaaatttatcccgcaggaggcggcagagatcattttgccggaactgccggggagcagtgccggcatgccacagccggcactttcgcagtctgtactgccggggactgcaatacagggatctgccgcacagccgaagataaaggtgcgtctgatcgattgtgtcgggtttatggtggagggagcatccggtcatatggaaggaaatgaaagccgcatggtaaaaacaccatggtcggagcaggaaattccatttacgacagctgcgtcgatcggtactcagaaagtgatccgggatcatgcaacgatcggaatcgttgtgacgaccgatggcacgatcggggaactgccgcgaaatgcatatgtaaaagcggaagaacagacggtggaggaactgaatgcgatcgcaaaaccatatgtcattctgttaaattcacaaaaaccgtacagtgatgagacgatggaacttgcagccgaactgaaagaaaaatatcagactgccgttttgccggtcaactgtgagcagctgcggaaagatgatattgtccgcattttagagaatatcctctgtgaatttccagtgacgcgtgtcgaattttttattccaaaatggacggaaatgctaaagccggagcatccgatgaaagcggaaatcattaaaactgcatccgggattttagacagtatgcataaaacgggagatgtaagagcactttcctttacaccggagcagtatgtttcgcagatcaagatcgacgagacggatcttgcgaccgggcgcgtggtggtgcggatggatttagacgataaatattattatgaaaatataagtgaactgactggtgtgccgatcgcaggtgaatatgagctgatctccatgataaaagagatggcagggcagaaagaggcttatgaaaaagtgtcagatgcttttgaagcggttcaggtaaaaggttatggcgttgtgagtccgggactttccgatatcaaaatggaagagccggtgctgatccggcatggcaataaatttggcgtcaaaatgaaagcggtatcgccgtcgatccatatgatccgtgcaaatattgagaccgagatcgctccaattgtcggcagcgaggagcaggcaaatgatctgatctcttacatcaaacagggacagcagagcgaagagggtgcatgggaaacaaatattttcggcaaatcggttggagaactgatggaggatggaatccgtaacaagatcgcaatgatggatgatgaatgtcagatgaaattgcaggatacaatgcagaaaattgtaaatgataatactggtggtatggtatgcattatcatttgatgcggtagtattgcgaaaacaaacgtaaaatcaaaaataagtaaccttaaaaagaaaagagaaaaacagatgaaaaaatttattcagggaatgtatcagaaaaagaattttggggtaaggctgactgctgtgatcctgtccgtaattgtgatgggatttgcactgtcgttgctggtgcttgtggatcttggaacagatccctgtaccagcatgaatcttgctatttcggaaaaaattggaatgggaatcggaaactggcaggcactgctcaatacgatcatatttgtctttgtcattttgcttggcagggaaaatatcggatttggaacacttgccaatatgtttttagttggatattcactgcagtttttttcctgggtatgggataagatcttaccggcaggactgtttgattcgatggcagtgcgcattctggtgctgattccggcactggcgatatttgttgtatcagcagctgtatatatggatgtgaaattaggaacagcaccttatgacgcgattgcatttatcattgcaaaatggatgccgaagataccgttccgtctgatccgtatggcatttgattttaccgttattgtgatcgcatttttattcggtggcaagatcggaatcgtaacgatcctgatgggatttacgctcggaccggtgatcggtgctgtcggtgagaaaatcggtcgttttatcgagtgcgactaaagaatcagatttattatcatctgatgatttttgcgggagatgctggtatttcccgcttttttgaaattcgttgtaggcatcctgataagcggcgacaatgtattctttcatgggatctttgtcgcttaccatcgacatggtgtccgaaaatactttggcagcttcttccttgcttttgcagtgttctaactgctgttcgagagagtcgcgcatcgcctggattctggctgcctgcatatagagctgtggatctactgcctgaagaaaacgcatttcttcttcggtcagttttttcccactttttaattttgcctggattctggctaattctgcctgcttttcttcttcggtcataccgcaggcggggcttaaaagctcggagatgttctgcgtcaggtcaaaggcatccatgccggaaacactgactgcatttaaagtatcatcaccggaagaaagaccgatggaagatttggataaacggtctgtaatctgatcgaccacattccttttgccggaagatgggtttaaaatcttttttaaaccggaaagattgaactgagtcataaaattctccattcctgcactgtgtttccgtgcatatgaaaagtatagcctgtgatgtattcttacaaaatatatcggggaaaatcagcttttgtttaggatggagattggattttatgatttcttctgttataatcgaaaatgacagtgttgtaaagaattttcaattatgaaaaaatgaagtaaggaagcatcagctgtttttgaaagacaagaagggagaagttccggagaagccggaattgacagaatataggacaaggagaagaatggaggatgattatgaatccggcatacgaaaaattattaaaatgctatgacagctataaagcaaagattgattttactcctaaggtggcattgattttaggctctggtcttggcgactatgcggatgatatccgcgtggtggatacgttagattaccatgacattgaaggatttccagtgtcgacggttccgggacataagggcagatttatcttcggatatgtggatgatgtcccggtcgtgtgcatgcaggggcgtgtgcattattatgagggatatgagatgagcgatgttgttttgccgacgaggctgatgaaaatgatgggcgcagaagttctgtttctcaccaatgcagcaggtggcatccagcttggcatgcatgccggggatttcatgctgatcaaagaccagattgcaagttttgtgccatcaccgctccgtggagccaacattgaggaacttggtgtgcgtttcccggatatgagccagatctatgacttagatctgcaggatattgtaaaacgtgcagcatcagcacttgagatccgcatcaaagagggcacttacatccaactctccggaccgcagtttgagacaccgcatgaagtcgccatgtgccgcactttaggtgctgacgccgtcggcatgagtactgcctgtgaggcgatcgctgcaaaacacatgggaatgaaagtgcttggaatctcctgtatctccaaccttgcgagcggcatctcatcaattccgctctcacacgcagaagttcaggagacggctgacgccgttgctccgaaatttaaggcgctcgtaactgaaacgatcaaagcgatcggagcacagcagaattaaagttactacaactcagtagatcaaaaacggcggtcacactttttgatccactgaacgaaaaacacaaaaagaaaagaggaaaaacaatgaacatacgtttctacaacgcaaaaatattagttctggcagaaaaccacaaattccagatcaccgaaggcgaactctgggtaaaaggaaaagaaatctgctacatcggggacggtaagacaggcgtggatgctgtctgcaaaaacggtgaagttttggtatgggagcgcgagattgacgcaaaaggcaaccttttaatgccgggatttaaagatgcgcacacccacacggcaatgacatttttgcgttcctatgcggacgaccttccactgcaggactggctgaacaaacaggtattcccaaaagaaggacagcttaccgaagatgatgtatattggcttaacatccttggaattatggaatatttaaccagcggtattacgtccaactttgatatgtacttcttcccgccggtcgatgcaaaggcatcggtagataccggattccgtaccgttcagaccagcggattgaacaactttggcggcacggtagagttgatggaggaaaattatcacattgtcaatgagatgagcgacctgacaagctttatcgtgggatttcatgcagaatacacgacatcaaaagaactgatggagggcgtggcaaaactggcacagaaattaaaatccccggtatggctgcacaattccgaaacaaaactggaagtggcagagtgcaaagagcgctggggcatgacaccgacacagcttacggatgcacttggtatgtacgagtacggcggcggcggttaccactgtgtatggtttgaggatgctgattttgaaatttacaagaagaaaaaactgacagcagtgacaaacccggcttccaacttaaaacttgcttccggtatctgtccgaccaaacgttttgtggatgagggaatctccatggcgatcggaaccgatggcccggcaagcaacaactgcttggatatgttccgtgagatgtttttgacttctgcacttgcaaaggtgcgtgaaatggatgcggagtgcgtcagcgccgatgagatcttatatatggcaaccacaggcggtgcacatgccatgcagttatttgactgtgacagtcttgcggttggcaaaaaagcagaccttgtcatgatcgatctgaaccagccgaacatgcagccggaaaataatatcgtgaaaaatcttgtatacagcggaagcaagcagaatgtaaaactgactatggtaaatggaaaagttttatatgaagaccagaaatttgacatcggatttgatccggcagatatttaccgccgtgcaaatgagatcatccgccgtatgaaataacagaaggagaattatgcaggtaatatttatacatcacagctgttttctggtggaagtggatgagaaggtgctgatctttgactggtttgcaggagaccgcatcaaaggatacacattttgcggtgtgattccggaatacgagccggacacaccagtctatgtgtttgcaagtcataaacatcaggatcattttgatatggatgtgctgcactgggcagaaaaatataaaaatatccactatatactttcaaaagactgtaaaatgagcccgcattttttacagaaacatggattcccggatgatatcagagagaagatcacttatgtttcggcaggcgaaaaatatcaggtggatgatgtgaagatcgagacactgcggtcaacggatgcaggtgttgcattttatgtggaaacacgaggggcaacttttttccatgcaggagatttgaatgactggacatgggaaggggcgggagatctgatcaacggcaggatgcgcagggaataccggacacagatcaaaaaactggcgggaaaaccaatcaatcttgcatttgttccgatggatccgcgacagggcgcagatcaggaactcggaatggattattttttggagaccacatccgcggaatatgtgttcccgatgcatatgtggcaggattattcccacatcccggtttataagaataaaatatggaatccggggatggcggagcgtgtggtggaaatcacacatgaaaatcaggttttcctgattgaggaacagtagtgttaacgctactgttcacaggcaggcattttctgaactgaaaatgccgtatgatacagtggtggcagcagattttgccgatttggaatgcgaagcatcggcaaaatccgttactggaacgaggtacgagtgaatagtaacatgttaacgcttgactcataggaaaaaagtgcgttatactgaataagttatagaagatagaaaggcaggggtatgtatggcagtatttggatggtttgtacattatgtgttaataatggtaattcttgcagctgttgcagttgctggagtatttgctggcagaaaatgggcagagaaaagcaaagcgaaaaaagacactgcagcttccggaaatgccggaaaagaataatgccgtcgtgaccctgcaaaaagacagggcatgaaatagtttatacaacgttggaggaacttgtcgtgaagaagttttatggagaaaatgaattgcgcagaatgtatcttgggttttttgaaagcaagggacatcttgcgatgaagagtttttcattggtaccacacaatgataacagtttactattgatcaatgcaggtatggcaccgcttaagccatatttcacaggtcaggaaataccgccgagaagaagggtaaccacatgtcagaaatgtatccgtaccggcgatattgagaatgtcggtaagacagcacgtcacctgacattttttgagatgcttggcaatttctcatttggtgattactttaaacatgaagcaatccactggtcatgggagtttttgacacaggttctcggccttgaggaggacagactgtatccgtctatttatggggaagatgatgaggcatttgagatctggaacaaagaagtaggtgttccagcagagaagatcacaagattttaccgtgatccggagaccggagaatgtgataacttctgggagcatggcgctggtccttgcggtccttgttcagagatctattatgaccgtggagagaaatatggctgcggcagaccagactgtaaagtaggctgtgactgtgaccgtttcatggaggtatggaacaacgtatttacccagttcgagggtgacggtaagggcggttacacagagcttgcgcagaaaaacattgataccggtatgggattagagcgtctggctgttgtgatgcaggatgtagattccgtatttgatattgataccatgaaagcgatccgcgacaaggtatgtgagatgtccggcaaaaagtatcaggtagatgcattagatgatgtgtccatccgtctgattaccgatcatatccgttctgcaacgtttatgatctcagatggtatcatgccttcaaatgagggacgcggctatgtactccgccgtatcatccgccgcgcggcaagacacggaagaatgctcggtattgacggtatcttcatggcgaaactggctgctaccgtaatcaatgagagcaaggatggttatccggaacttgaagagaaaaaagattttatctttaaagtattatcccaggaagaagaaaaatttggaaaaacgatcgatcagggactttccatcctttctgatatggaaaaacagatggaagcagacggcgtaaaggttctttccggtgagaatgcatttaaactttatgatacttatggattcccgatggatctgacacaggagatcctcgaagaaaaaggattttctgtcgatgaagagggattcaaaaaggcgatggaagtacagcgtaccacagcgagaaaagcccgcaaagtgacaaactacatgggcgctgatgagacagtatatgagtctgtcgatccttctgttaccacagagtttgtaggctatgattccttaaactgcaagtcaaaaattaccgtacttaccacagagacggagatcgttgaggcattatctgatggagaggttggaaccgtgatcgtagaacagactccattctatgctaccatgggtggacagcagggagataagggtatcatccgcactgcagccggagaattccaggtagaggatacgatcaaattacttggcggaaaagtaggacatgtcggaaagatgatctccggtatgatgaaaacaggagatgaggcagatctttcggtagatgcagcactccgtgcaaagatctgtaagaaccattccgcaacacatttactgcagaaagcattgcgtgaagtattaggaacccacgtagagcaggcaggttcctatcaggatggcgagcgtacccgtttcgatttcagccattttgcagccatgacaccggaggaacttgaaaaagtagaaaagatcgtcaatgataagatcgcagaggcaattccggtacgcacagatgtgatgactgtagatgaggcgaaaaagacaggagccatggcgttatttggcgaaaaatacggagagactgtccgtgtggtatccatgggagatttttccaaagaattctgtggtggtactcatgtaaagaatacatccgaaatagcagcattcaaaatcatctctgaaaatggtgttgcagcaggcgtccgcagaatcgaggcactgaccggagacaacgtatttgcttactatcgcaatttagagaaagaacttttagaggcagcgaaagcggcaaaggcaacaccggcgacattaacagagaaaatcgagcatatgcaggcagagatcaaagcactgaccagcgaaaacgagtccttaaagagcaaagcagcaaaagaggcgcttggagatgtcatggatcagattgtggaagtaaaaggtgtgaaattacttgcttctgccgtagacggtgtagatatgaacggtctgcgtgatcttggagaccagttaaaagaacagcttggtgaaggcgtgatcgtacttgcttcttcctgtgaaggaaaagtaaatctgatcgttatggcaactgatgcagcaatgaaacagggagcgcatgcaggaaacttgatcaagagcattgccggcaaagtcggcggtggcggcggcggacgtccaaatatggcacaggcgggaggcaaaaatccggctggtattttggaggcgatcgcagaggcaaaaacagcacttgaggcacagctttcctgaaagctgtttagcatgattgtcccgcaactgaagaatcacggaagatgacagatttttagctatggaggcaaaagatggataaagaaatggaatttaaaaataagagtattaaagaaaaggtaaacggaagctttgaaatgatcatagttttatatgtggtcagcgtggcgtttgcagtatttttaatgtttgcagtaaaaattgttccgtctgcaacagagtattttgtgcttgccggaggtattgttgtgcttgcgattataacagtctgcagtattctggcaacattgaaacgggctaagatgctgatacactatattgtagaaccggtcagggaactaagtagtgtggcagaaaaaatctctggtggagaacttgatattgaaattgcttatcagtcggaggatgagatcggagaacttgcagaagattttcgcaaaacagcaactacgctgcaacggattataggagatcttaatcatattctggatgcatttgcaaaaggtgattatacggtaaaatccggatgcagggatgcttatgtgggagaatttgatacggtgcatgcaaaactgattgcaacaacagaacatgttagtgatgctttaaaatcaatccgtgaatcttcgaatcaggtggcacagggatccgaccagcttgcagtcagcgcacaggatcttgccaaaaatgcaacggatcaggcagtggccgttgattctttagcacagagcgtttcagaaatcacagaacagattcttggaacaagtaagtcgattgatattgtacatgataaagcgaaagacgttggaacaacagcagcggtaagccagcagaagatgacagaactgacagaggcaatggagcgtatttccgtgacatccaaggaaatcggacaggttatcgaagaaattgagagtattgcatcacagacaaatctgttgtccttaaatgcatctattgaggcagcaagagccggtgaggcaggaaaaggatttgcagttgttgcagagcagatccgtatgcttgctgagagcagtgcaaattctgcagatacgtcaaaacagcttttgacagagaaccagaatgaagtagaacacggtaatcaggtgacacagcagacggcagaatctctgacggatgttctgaacgaactggatgctattgtgggtgaggtagcaacgatccgtacggcatctgatcgtgaggcagcctttgtaaaagagatcgaagacagcacgaaacaaatcagcgacgcaatccagagcaactctgcagcatcggaagaaacatctgctaccagtgaagaactttctgcagaagcagattccttagagggccttgtagagcgttttaaactgcgttaaatgtttgtttaatacagaggagagaaaatgcagatgaaaataaaggaaaagatgattgctgtggttatggcatttgcaatgatgtttacgtttatttttgcaggtgaaagcagtgaagtaatcgctgctgcgaaaacaaaagcattagagataaatgttgattttgccaggaatgcagcaagtggagatgacagcgggatatatgtaaagagcctgatttccaataaaaaaattacttttggaaagacttatgtatttcagacaaaaatttatgtgccagccgtttatatgaaaactggaagaatatgggtaaaacctgcagttaatttttttacaggcaaaaatggcgatacatatgccggaatggcacagtcttcgaaagaaggatattcttatgataagaattcgaaagaagtaaaaaaatatggtgatttttatgttgtcaatgtgaaaatatcattggataactgtgacaggatttctgcatcaaagggaagtgtgtatggacatctgttcatctctggttttaataaggcatataagggaagtatttatgttgatgatgtgacacttactgtagataagaaatcagttgtaaagcaaaattatgagaatggaaaaaacagtggttgctggtattatcttaacagatcagaaaaggaatatacacctgcagttgtttcattctcaggaaaaacattggatgtgactaagacatcgcttgctataaaaaagggtaaaaaagcgacgatcaaagccactgcaatgccaaaaacaaaaatagcatatcagtctaagaacaagaaagtcgctacagtaaacagtaaaggtgttgtccggggcattcggaaaggaaagacaaccattcttgtcacagcgaatgggaaaactgttaaagttcagattaccgtaaaataatttcaaataaaaatctgaaattctttcaaaaataggttgacgaaccgggaaaatatgttataatgctatatagtgcaataaatattacccaaacagttgaatatgcacaatacgcaactggagggaggttaggtgtgagataatgtctagtgtaattgtaaaagaaaacgagactttagatagcgctttacgtcgtttcaaaagaaactgcgcaaaagcaggtatccagcaggagattcgtaaaagagaacactacgagaaaccaagcgtaaaacgtaagaaaaaatctgaagcagctagaaaaagaaaatacaactaataattagttgtagtgcaaaaagactaccgcatgtgtggtagtcttttttttctctgagtgaggttatttaccagatatattttattgcgataataagtctattcgtaaggtggataatctgttactgttcactcgtacctcgttccagtaacggattttgccgatgcttcgcattccaaatcggcaaaatctgctaccaccactgtatcatacggcattttcagttcagaaaatgcctacctgtgaacagtaacgataatctttagaaatatcgtggagcaaagggcatagtattgcagaaatgcataaatatgtttataatatgagaaaagatgtatgaaatacgaatttaagatagagacagaatatacgaaatgagtagaatggagatgatattttatgattaatttaaaaaactgccgggtaattatccgtgaacagaaaaaaaacagtgtacttgcagacacggtaattcttggtcataatctgctgacaaatatcatcaaagtgcgggcgagtgcgatggcatatcgcccgaaagaaccagtgggactgcttgtttttctggagaacaaaatatattcttatttaggtaccgtacagggggcggtgatcgcaaacgaaatgtcgattgcgctatacgatgaagaacagaaaaaaggcagaaaatttgagcgttatgagattgaagcatctggcaagatcgaaggtgtcaggataaaaaataacatgataacgctccataagccgataccggttaccatcaaaaatatgagcgcaaatggtgtactgtttaaaggaatttccggctgtctggacgttggaatgcagctacagctttatatggatgtaactgattcaggaatgcgttatgagtataaagtggttcgtaagcagaacagcaatccggagaccgaagagtatggttgtaaaatggttgcaaaaaagaaatagcagccatgggaaattattttgaaaagatacgaaaaaaggaaccgtaaaatatgaaaaacagttaacaaactgaaaaattcatattttcacggttcttttttaattaataaccgaaagattctccaatcaaaagtactttgatacgtcctttgattccacttcttctggtgatgacaacctgattacagatacagtccggagaaagacagtctgcgcaggcaccggttatggcacaaggtgtttttttgtcaagacggatacagttttgtgctgtggcaacattatgtacacggctcagggcctcgtctacatttgcggcaattttattcattccagctaaaataacaacagtttccggaccatagatcagtgcggcaacacggtttccggttccatcgatgttgacaagctcgccaccggttgtgattgcattggtactcataaaatatacgtcgctgaaaagagcgtcgtgatacattttttttgtttcatccggtgtttttgcggttgagcggtcgatcagatggatggaaggatcatggcggagcgctgtcagcatgccggtctcctctaaggtcatggagccgccgaaagatacggtctgcccatcttttaagaatgaaaatgcaagtttttctgcgtcttctacggtcgggcagtagtagccttccatctggcgtttttcaaggtttttgatcactgttgcagcaagtgtttcatggtatttgcttttgattgtatccatacatgtactcctttttatcgtatttgacattggatcgcactttggcagtctcaatgtcactgtgtgcttcttttagtatagcacatattcttgacttttgggacaggatagataaaataaaagagttggaaatggaggaatactatgagtaaaaacctgaaaaagatgatttcatattataagccgtatctgggagtgttctgggcagatatgttttttgcaacggtatctgcggcggtcgcgcttgtgatcccgcttgtgatccgttatgtgacatctacattaatctatatggaaccgcaggcgattttaggacagatccgttggattgcgcttatgttattcgcactggtggcggtagactgttacagccgtttttttattgcaaatcaggggcatgtgatgggcgctaagatcgagtatgacatgcgtgcggagatttttgcacattttcagaaactgtcattttccttttatgatgatcagaaggttgggcagctgatgtcccgtattacgacggatttatttgatatcacagaactgatgcaccatggaccggaaaacattatcctttccctgatcaaaattattggtgcgttcgtgatcttaatgagtattaaaccggcacttgcacttgccgcatttgcagtgctgccgttcatgtttctgtttgcctattacatgaacggaaaaatgcgccgtgcgtttcgcagcaaccgcgagcggatcgccgatatcaatgcacagatcgaggataatttgtccgggatccgtgtggtaaagtcatttgcgaatgaggatatcgaaaaagaaaaattccgtcagggaaacgaaggctttctgcgcgcaaaaaagaacagttattattatatgggaagtttctcggcaggacttggtacttttacgaccctgatccaggtaaatgtcatacttgcgggtgtcattctgatcgcaaagggaagtgtggatatcagtgatctggtcacatttttgctttatatcagcgtgtttacagagccggtgcggacactaattgattttacggaacagtttcagaacggatataccgggtttgaacgttttcaggagatcatggcgatcgaaccggatattgcagataaagaggatgcaaaagagctggtcaatgtcaaaggcgatatcagctttgaggatgtatctttccagtatgaggaaaatacggaatgtgtgttaaatcatattaacctgaacgttccggcgggggcttatatggcacttgtggggtcgtcaggagctggaaagagtacactgtgttcactgattccgaggttttatgatgtgacggcaggagcagttaagattgatggctgcgatgtccgggatatcaggttaaagagcctgcgcgaccatatcggtatcgtacagcaggatgtgtatctgtttgtcggaaccgtttttgataatatccgttatggaaaaccggatgcaacacgtgaggaagtgattgaagcggcgaaaaatgccaatgcacacgattttatcatgtcgctgccaaatgggtatgaaacagatatcggacagcggggaatcaagctttccggcgggcagaaacagcgtttgtccattgcaagggtatttttaaagaatccaccgatcctgatctttgatgaggcgacgagtgcacttgacaatgaaagtgagaaagtcgtgcaggattctctggaaaaactggcaaagaatcgtacaacatttgtgatcgcacaccggctttccacaatcaaaaatgcacagcgaatcctggttttgacggaggagggcattgcggaggaaggaacgcatgaggaactgttagaaaaaggcggtgtgtatgaaaaactgtatcagatgcagtttcataaataagagtgctgtgtagaagagaagtgtatagcgtaaaatataaaagtttcatgaaatccatgcaaaaatttgcaaaagaggaaaaactagagtaaaatagtagtgtttgtgaagggagagataagacaatgacaaaaattgatattatatctggtttccttggagccggaaaaacaacatttattaaaaaaatgatcgaggaagtttttaagggcgagaagatcgttctgattgagaacgaatttggtgaagtcggcattgacggaggatttttaaaggatgcaggaattgagatcacagagatgaattccggatgcatctgctgttccttagtaggcgattttggtaaaaacttacatgaagtcatcgagaagttccatccggaccgtattttgatcgagccgtccggtgttggtaaattatccgatgttatgaaatctgtcatcgacgtggaaaaagacgaggatgtcaaattaaacggactgatcacggttgtaaatgcattaaaggcaagcaaacagatgaaagcatttggtgaatttttcaacaaccagatcgaatatgcgacaacggttgtcttaagcagaagccagaaggcaacaccagagcagttagagctgtgtgtaaaacagatccaggcattaaatccgaaagctgctgttatcacaactccatgggatgagatcaaaggcgagcagatcttaaaagtagtggagggacaggactctctggaagtaaaacttctcgcagagcagcatgcaaaagaggaagctttagaacatgagcatgagcatcatcatgaccatgaccacgaagagcatgaacatcaccatgatcatgaccacgaggagcatgagcatcatcacgatcacgaccacgatcatgaggagcatgacgagaactgcacctgtggctgccatgatcatgaccatgatcacgaagaacatgaacatcaccatgaccatgaccacgatcatgaggagcatgacgaaaactgcacctgcggctgtcatgatcacgatcatcatcaccatcatcatgcagatgaggtatttacaagctggggcaaggagacacctcataagtttacaaaagagcagattgaggaagtgttaaagacactctgcgagacagacgactacggcgagatccttcgtgcaaaaggtatggtagccgatgtgaatggttcctggatctactttgacatggttccgggtgagtacgagatccgtgagggagagccagattataccggaagactctgtgtgattggtacacatattgacgaacacagattagaggaactgtttggaatcgcgtaaaagcgggaaaaagttactcaggaatggagatttatatgaacgaaataccagtatatttatttaccggttttatggacagcggcaagacgactctggtgaaggagacgttatttgatgatggtttcactgagggtggaagaagtgttgtgatctgctgtgaggacggagatgtcgaatatgacgaggaggagttaaaaaaaatcaacgccagacttgtcatggtagaaaatgaagaggattttaccgaagagtttttaaacaaagtgcaggcggaatatctgccggagcaggtgtttatcgaatacaatggtacctggggaatgggaacactgatggatatggaactcccgaaacactgggtgatcgtacagcagttagcgactgtggatgcgacaacgtttgacatgtatcttgcaaatatgcgtaccatggtaatggagcagttatttcaggcagatgtcgtgatctttaaccgctgtgatgacagcacggacaaaggcaaatgccgccgtaatgtcaaggcacagaaccgcaaggcacagctcgtcttcgagcgtgaggacggcagcttggatgaacgtccggaggaacttccgtttgatctttctgcggatgtgatcgagatcaccgatgcagactatgcaatctggtacatggactgtatggataatccgaaaaaatatgagggcaaaaaagtatctttcctggcattggtatacaatccggaaaaacttaaaaaaggagtgtttgtgccgggacgttttgcgatgacatgctgcatcgaggatgtgacatttatcggatttaagtgtaaatatgcggatgaggacaagatcccgcacaaatcctggatcaatatcactgcggaagtgcatgtggaatttgcgagagagtataagggaaaaggaccggtactttatccggtatccatcgaaccggcagaaaaaccggaagatgagctggtatatttctcgtaaaccggatatgttctgcatgtgtaagctgggaagaataatcgctgctggtcacacttggagatgtgaacagtaacaaatagatgcataggaaaaggacagaagttggaatccgaagaatccagtttctgtccttttaaaatttttagtaatcagatattattttttgtgttcttgtttttctttgaacctattcttccttgattccatgttcacgcatatactcaccaatctttttatcggaacctaaaatgtggttgatcagccatccggacaaaaaattgatcaggtcaatcagatattcctgctgattgtcatccatttcgtccaaatctgttaaatcaacctcaacaagacgttccacgaaggcagcatgtgcacgtttctgagcactgatttccggataatggatgcgttccatgagattttcttcatcacggaaatgaaattctgtatagtcttttaattctgcaagcaggtgcatgatctcatcatatttgtcatgcagaagttctgcgtgaatcagatcgttggtatcgtgaatgatctcaaacagccgtcggtgctcagtatcaattaactcaacgccggttttgtatttttcgcaaaatgcaaatggatcttcttcatcagcagaaatagaagacatttttccgatcatcgtatcactgcttaagatatgccggtataaccagcgagccagataagccagcaggtcgtttagggattgccttgctgcttccggggaagaagtatccagagcaaaagtgttgattttttttgtaaatgcttcatgttcttttttttggatcggaagctcaggatcatgaatatgctccatgtaagcttcctcatgggcgaaatgtgttgcagcgtaatttttcaatccggaaaccagattcttagagataacagagatatctgaactttcttttgaaaggtcaatcgcttcatttatcatctgaaataaccgacgatgctcattatcaatctcgtcaattccaattaaatagtcgtctgtaaatttatacattataaaatcctccattccgtggtaaataccacttttcttttgaataaaaatatagatttcccagcccataattatatttatggagttatatgggataatacatcaacattataacatgaatccgtgtgagaaaaaagaaataaaaaaagaaaataaaaaacgtgttgacaaaatcactttaatatattaaagtatacccataaagaaaaaccgttgagaaagaatagtaagcattttttgatattacagagagctgcaggtggtgggattgcagtatggatggatttgctgaatggacttttgagggcggcctgaacaggatttagtaggcgccgccgggaaccggacccgttacccatccggcatgtatggttgtacatgaagtgagtggacttttcagtcaatatgagtggtaccgcgataatagatactattaccgtctcaggcaagaacctgaggcggttttttaatgtaaaattcatttacattgtaaacgaaagtttgcatgatgacgaattccacctctcgaaacggctttttccaaatttaaaatctggagggaacaagtgcgaaaaatagaatttttcgcacacaggatttgtgcttatgcacaaacctgtaatgcgcagagaacggcgcagaaaggggaaagaaatgaaaagaaaaatgatggcagcagtattagtgatggcaatgacagcaggtgtgcttggtggatgtggaaacagcacgggaaataatgcgaaaacagacacaaatgcacagaataatgcaaataccgcagaaataaaagagaatgccaatgcggatgtgacagagatcgccaatgcagatggcacggtatataaagttggtatcgtccagtatgtagatgatgcttccttaaaccagatcgagaaggcgatcgaggcagagcttgatgcaaaaggtgcagaacttggtgtgacattcgattatgcagattatacctataatggtcaggcagattcctctaccttaaatcagatcgcaacggatctggttgcagaaaaagtggatgtgatcatcccgatcgcaacaccggcagccatgatcatgcagaatgcgacagaggacaatcagatcccggttgtattctccgcagtatcagatccggtcagcgcaggacttgtcgcagatttaaatgcacctggtgcaaatatcacaggcacatccgatgcacttgacaccacggctgttatgaaactgatcacggcagccaacccggatgtaaagaaaatcggactgttatatgataagagccaggattcctcaaaagtgccggttgcagatgcaatcgcttactgtgaggaaaacggtattgaatatattgaaaagacaggaaccaccaatgcagaggtatctgcagcagcagatgcgcttgtggcagaaggggtagatgcagtattcacaccgaccgataacacaatcatgacagccgagcttgcaatctttgaaaagtttgcagatgcaaagatcccgcactatacaggagctgattctttcgcgttaaacggagcattcttaggatatggcgtcaattatacagagcttggaactgcaacggcagatatggcagcagacatccttgtaaatggtgctgatcctgcagcaacagcagtctgcacattagacagtggtatcgtgactgtcaacacggagacagctgcagctgttggcattgatgacagtgtatttaaagatatgtgtgaggaattaaaagaagttacaaccgcagaagaatttgaataaaagcggaatagaagaaaaacggaaccggaggggattatgggttcgatcattacactttccattgtacagagcgcattagaacttggatttatctatgcactggttgcgcttgcattatttgtatcattttccatattagatatcgcggatctgtcaacagacggctgctttacattaggctgtgcagtctgtgcgacggtgacgcttgccggacatccggtgttaggactgtttgcggcggcggcagcaggagttgtatcgggattcgttactgcatttttacagaccagaatgggtattcagtccatcttagctggaatcatcgtaaatacaggattatacacgatcaacattgcggtgatgggttttgcatccaatatcaatcttttttcctgtgacacggttttttcatgggcgaaagatcatatcgggggaacctggtataaactgatcgttgcagctgtatttgttgtgattgtcggtgtgatactggcatggtttttaaatacgagactgggactttccatccgtgcgaccggcgataacccggatatggtaagggcatcaagtatcaataccggacttatgatcacgatcggactttgtgttgcgaatgccatgaccggactttccggcggactgctcgcacagtatcagaaatcctgtgatatcaatcttggaacgggaatggtaacgatcgcacttgcgagtctgatcatcggggagtcgatcatcggaaaaggcggtgtgttaaagcgtgtgatcggcgtggtattaggaagctgcctgtaccgctttatcgtagcgattgctttaagagtaaatgttccggcagaatgtttaaaattggtatcatcacttatcgttgcatttgcgatcgcactgccttatctgaaaaagcaggcagcgtttatgaaacagcgccgccttgcaaaggcagaaaaccagttatatatggaacagatccagaaacagaaccagaagaaggaggaaccgtgatgttaattatgaaaaatgtcagcaagaccttcaatccgggaactgtcaatgaaaaatgcgcattaaaaaatctgaatctggaattgaaggatggcgactttgcaacaattatcggaagcaatggagcaggtaaatctacattatttaatgcaatcaccggagcattttttatcgaccggggacttattgtgttagatggggaggatatcacttaccagaaagaacatgtgcggagcaaggtgattggtcatttgtttcaggatcctttaaagggaaccgcgccgcatatgacgatcgaggaaaatatggcacttgcctatcttcgcgccaaaacctcaaaaaatgcatatttcagccgtatcaatgcggcggataaggcaaaattcagggagcaccttgcactgcttgatatggggttagaggatcgcatgaagcagccggtaggactcctttccggaggacagcgccaggcactgacgcttcttatggcgacgatggtcacaccaaagatcctgctgttagatgagcatacggcggcattggatccggcaaccgcaaaaaaagtgctcgacctgaccaaacagatcgttgcagagagaaagatcacctgccttatggtaacccacaatatgcaccaggcattagaacttggaaaccgtaccctgatgatggattccggaaatatcatcttagatgtgagcggagaaaaacgtgcgggcatgacggtggaggatctgttagagcagtttgcggtctgtgccggaaagcgtttggacaatgacaggatcctgttttcgcaggcggaatgatggttagtcaacgacaggatcctgttttcacaggcagaataagggaaaaataggattttttgcaggatctggcagtaataatttgagaaaaaacagaactaattgagaaaaaatagaggaaagccgttgaaatttaacgtgttttcctttattatgttaaagtatgaaaataaatactttgacgggcatgttgatgtatataaaaatgttaggaggagaccatgtatccaatcgtaagaagagaaaaactggcagataagatttatcttatggatgtcaaagcacctcgtgtggcacagtactgtgagccggggcagtttgtaattgtaaagattgatgaggagggcgagcgtattccgcttaccatttgtgattatgacagggaagcaggtacgatcacgatcgtattccagactgtcggagcatctacagagcgtatggcatatttacaggaaggagatgcattccaggattttgtaggcccgcttggatgtgcgtctgacctgattgacgaagatattgaagaattaaagaaaaagaagatccttttcgttgccggaggtgttggtacagcaccggtatatccgcaggtaaaatggttgcatgagcacggtgtggactgtgatgtgatcatgggatctaagacaaaagatctgttgatcttagtagaccagatgaaagaagttgcgacaaatctctatgtgacgaccgatgatggttcttatggattccacggtatgggaactaatcagttacaggaactctgggatgcaggaaaacgctatgatcactgtgtagcgatcggaccgatgatcatgatgaaattcgtatgtaagctgacaaaagagcttggaatcccgaccgttgtttccatgaacccgatcatggtagacggaaccggaatgtgcggtgcatgtcgtctgatagtaggcggggaagtaaaatttgcctgcgtggacggaccggagtttgacgggcatcaggttgattttgaccaggcgatgaaacgtcaggcacagtacaagacagaagagggaagagcgatgttaaagctgcaggaaggtgatacacatcacggcggctgtggcaactgtcagtagggttgagcgtttgaaaaggagatagagagaatggacgtattaaatagagtaccggttcgcgagcaggaaccacaggttcgtgcggctaactttgaagaggtatgtttaggatataacgaggaagaggcaaaagctgaggcagcacgctgcttaaactgtaaaaatgcgcagtgtatgaagggctgtccggtatctatcaatatcccggcatttatcgcacaggtaaaggaaggaaactttgaggaggcatatcacattatcagtcagtcttccgcacttccggcagtctgcggacgtgtctgcccacaggagagccagtgtgaaggaaaatgtatccgcggaatcaagggtgaaccggttgcaatcggtaaattagagcgttttgttgccgactgggcaagagaaaatggtattaaaccgaaaaaagcagagaaattaaacggacataaggttgcagtcatcggttctggccctgcaggtttaacctgtgccggagatctggcaaaacttggctatgatgtgacaatctttgaggcacttcatgaggcaggcggtgtactgatttacggtatcccggagttccgtcttccgaaacagaaggttgttgctgctgaggtggaaaatgtaaaagcactcggtgttaagatcgagacaaacgttgttatcggaaaatctgttacaatcgatgaattaatggaaaacgagggatttgaggccgtatttatcggttccggtgccggacttccaagatttatgggtattcctggcgagcaggcaatgggtgtattttctgcaaatgagttcctgaccagaaacaacctgatgaaggcatttaaagatgagtatgatacaccgatcaaagcaggcaagaaagttatcgttgtcggcggcggtaacgttgctatggatgctgcgagaactgcaaagagacttggcgcggaggtacatatcgtataccgccgtggcgaggaagagcttccggcgcgtgtggaggaagtacatcatgcaaaagaagagggcgtgatctttgatctgctccagaacccgacagaaattcttgtagatgagaatggctgggtaaaaggcgcgaaagtcattaagatggaactcggtgaaccggatgcatccggaagaagaagcccggtagagattccgggatctgagtatgagatcgaggcagataccgtgatcatgtcacttggaacttcaccgaacccgctgatctcttccactacaaagggacttgagatcaaccgcagaaaatgtatcatcgcagaggaagaaaacggtgctacctcaaaagccggtgtatttgccggtggtgatgccgtaaccggagctgcaactgtaattcttgccatgggtgcaggaaaagctgccgcaaagggaatcgatgaatatctgagcaataaataatagaccagtgatggtaaaaatgccggagtcagtggaaactgctgatgtccggcattttttcttaaaaactttttttataaaaatttcttaacacatctaaaatattccttaaatcttatccaaaacctactttttttcaaaaatattggttatacttgtaagcaaagttatgatgaattgtaaatgagtcagagtgacagtgatgaatactaagaggtatagctatatggaggaaaatgtgaaccagacagagaaagaaatggcagaaaacgaaaaacagaatcagacgggaaaagaagtggcagaaaacgaaaaacagaatcagacgggaaaagaagtggcagaaaatgcaaacttggaacagacagaaacgatccggggactgaccgcacagcaggtggaggagcggaaagaaaagggactctggaacaaaaaagcagagtcggcgacgaagacgacgaaagagatcgtaaaatcaaacgtatttacatattttaacctgatatttttagtgatcgcgttattgttaatcggcgttggtgctttccgggatctgacatttcttccaatcattgttgcaaatacgctgatcggtatcgtgcaggagatccggtcaaaaaaggttttagacgatctgtctatcttgaacagtcccaaaacgagagtgcttagggatggcagtaaaaaagaaataccggcagaagaactggtgatggatgatattgtggaactttctgcgggcgggcagataccggcggatgcagttgtgttagaagggcagttaaatgtgaatgaatcgcttcttaccggagaagcggatgaaattgtaaagaaaaatggcgatgaactgctgtccggcagctttgtggtgtccggcagctgtctggcacgactgacaaaggttggggaagagtcttatatatcaaaacttacccaccgtgcaacacagacgaaagagggagaacagtcagagatgatccgctctttgaaccggctggtgcaggcagtcggtattgtgatcattcccattggtgtggttctttttatacagcagtttgtatatgcgggaacccctttgcgggacagtgtgacaagtatggtcgcagcgatcattggaatgataccggagggactttatctgttagcgagcgttgccatggcggtaagtgccatgcgtctggcaaagcagcaggttttgatccatgatatgaaatgtattgaaacgttagcccgcgtagatgtactttgtgtggacaagacaggaacaattacagtgccggagatggaagtggatcagtttattcttgcagaagacctgacgaaaagagtttatgagaaagacggtgatacgaaagtatatgtcgatgtaaagtgcggtgaggaacaggaacaaaaacatgcgcagataaagggcatgatcggtgagtttgcggcagacatggatgccgataatgcaacaatggaggcattaaagacatattttaagccggatactttaacaaagataaagaaagcagaaaaggtatttgcattttcatcaaagacaaagtacagtggaatcatttcagagggaaaaagttatgtgatcggggcacctgaatttgtgcttcgggaggattatgcagagtacaaagaccgaatagaagcgtatagtgagaaagggtatcgtgtccttgtgtatggcagatatgagggaattttagacggacagcagcttacggaaaaagtattgccgatcgcgtttatcatgctgacaaatgcgatccgggaaggagcaaaggaaaccttttcctattttacagagcgtggtgtggagatcaaggttatctccggggataaccctaagactgttgctgaaattgcggaaaaagcgggaatctgcggcgcagataattatgtggatgcatccacgttgacaacagatgagagtatcgcacaggctgtagcaaaatatcagatttttggcagggtgacacctgatcagaagttaaagtttgtggaagcgctgaaagcacagggaagaacggttgccatgacgggtgacggtgtcaatgatgtgctggcattaaaagatgcggactgcagtatcgcaatggcatcgggaagcgaggctgcatcgcaggtggcacagcttgttcttttggacaatgatttttcaaggatgccctctgtagtgatggaagggcggagagtggtaaataatatccagcgctcggcaagcttatacctggttaaaaatattttttccatgctgcttgcagtattttccatgatctctatgatcaattatccactggaaccgtcacagatttcgctgatcagtatgtttacgattggaattccgtcttttgtgcttgcattagagccaaacaaagaccgtatacagggacattttatgacaaatgtattgttgaaggcattgcctgccggacttaccgatttttttgctgtcagcagtctggtattgttttgtcaggtatttggtgtgaacgaagaggacatttcgacatcctgtacgatacttgttgctattgttggatttatgatcttatatcagatcgcaaaaccgatgacggccggacaccgggtactgatggttggaatggtcgccggctggctgttctgcatgatatttgtcagccacttatttgcaatcagggatatctcagggcagtgtatgatgctgactgcggtatttacggttgcagcggagtccattctgcggtatctgtcgaaatttgtggagtggatgcgggaaagtcttttagtgttaaaaaagaaaatacatcaggcaacagcatgaaagaggacaggtattcggtaaggataaaaaccggataaaaaacagccgctccgtttttaaagcagagcggctgtttagcaatcaatttttgtgaaaatgaaatgttgtagttattccagattaaggtgttttttgatgataaccatgcacacgatatagaaaacaacacattcgatgatcgaaaagagcgatccggaaaacagcatagaggaaacagttgtgctgaatgtaacgttttcagtggcattataagttacaacattgacgttgttcatgacaccaaaatatccggtaagtaccaggatgatcgaggatacaatctgacctgacatgtaaaagacgattccggcaccgatggaagctcctactttatgttttgtaaagagctgaccgatagaaccgcttgcaaataccatcaaaaggtactgtaggcaggataagatcatggcaaaaatcatataaatgctaaacgtatggagagacatgccaaacagattctggaaatctaccatgagcatatcaaaatctgcatcaaaggaaaatcctctgtttgccgcacagcccagggcgaagatcgatacaaacataatgatcagggagagcatcagccagcatagggaaacgagcagttttacattaaaaattgacatctggccaaccggcagtgtgtgtgtcaggtatccctgatcagaatacattgtcttataaaaatgtacacacatatatacatagcttaccacgaaaagtgcaaatacgccgagtacataaaataccatagctgctgtaaagaagatctcctgtaactggttttctgtgccggcaggatcactgtcaccgtacatggcaatacagccaaggatggtaacaaacgccataacgccatagatgatgaacattaacttgtatgtgtttttaaattcgtatttaaataattttcctaacatctgaatacctcccggaacagtgcatcgacggatttcccctcctcggcgcggatatcgtccacagaggatgagagacggatctgtccgttctgaataaaaataacctggtctaaaatgttttcgatatctgcaatcaggtgcgttgaaatcaggatggaagcggacggatcgtaattggttaagatcacgtctaaaatgtaatctctcgcagcgggatcgacacctgcgatcggctcatctaaaatatataattctgctttgcggctcatgacgaggataagctgcactttttctttcgttccctttgacatgctttttagagaatcatttggattgatatttagtttttgtagcatatcataggcgcgttcgctgtcgaaatcttcataaaagtcctgaaagaaggcgatgatctctttcacacgctggttcatattcagataactatgatccggcagataggaaatgtggcgtttgctctcgacaccgatcggattttctttgtaataaagggtgccggaggtcggggttaaaagtccgttgatcattttgatcagtgttgtctttccgctgccgtttggaccgagcagaccaatgatatgtccgctctcaatcgaaagatcaatgtggtcgatcgctgtttttccactgaaacttttggtgagatctttgcattcaagtaatgtgcccatcatttttctcctttcatggtctgaccgatcatagccagaatctcattttcctgaaagccgagctgctgcataaatgagagcagttctgtaattttatcttttgcaagtgttgattttaattcatcgatcatggaagtgtcctccgtaataaatcgtccggttgtccgctgtgagaaaacaagaccggttcgttcaagttctgtgaaagctttctgcatcgtgtttggatttaccgctgcctcggcggcaaggtcacggacagaaggcagtttgtctccgggtttatatttgcccgaaatgatatccatttcgatccgttcgacgatctgtataaaaataggacggtcggaattaaggttccatgccattgtatcacctcgtttctttgtactagtgaaataatacaataatacaagaaaagtgtcaagagatttttttgtaaagtattctgattttatgacgatataaattacataacaggagaaagctaaggatggcgtctgattttcaaggaatgaaatacccggaaaaacaggcgccattttgttatatggatgaaaaatcagctgtataacgggaagaacttaactgttgtcataaaatgagttgtgaaatggggaaaatgagtatgagagttggaaacagactaaacagcaccattgtgcgtgcgcggatgaaacgtattgcaaagacgaagacatttacgacaaaacggcagagaacacaaaagagcacttccgggagttccggacagtcgatcagtcagcttctttcaaaattaaatgcaaacagtggaaagacgtcatctgcggagcagttacttgcaaaccggacgcagacgcttttgtacagtggtatggagacggctgcggaacgtgtggaaaaacggttgggaaagtttttaaaaacggatggtacttccgtatttgacgaggaagatgagacaaagctgaaggaaaatgtggcggataatatagagtcgtttgtgaatgactataattatctgatgaagcgtctcgcacagtccggcgatattgttgattcaaattatgccaaaaaactgaaaaattatgcaaatgcggaaaacaaggaactccgtgagatcggaattacgataaaaggtgacgggacattagaactggacgaaaacaaattaaaggcagccgatatcagccaggtaaagaaactgtttaccggtgaagatggatttgccaaaaaggtgtcgaatctgtcaggccagatcggcaaatatgcaaaagaaaaggtgacggaactcgagaaatcaagtgcgcaggcgagcagtaattataaccgttatgcacgctacgtgaataattcacagagttataacagcagttattataacaatagctattataacagtaaggcataatgacagatcagttttacggtgaagaatcgatcaaaataaagcagacggcaaagacaggctgggtacagtccgaattcagaaaacaggaaaaataccgtagaaattattatggaacgatcttccttgaaatcctcttagacaaaatgcagcggaaagaggatgtcctctacattgagtcagtcagggcgccgcgggttgtgcgggtgaagcggagaaaaaaagagccggatccgaaaaattgcaacgtgatggaaaagcaaaatgaacctgtcgcaaaaacctgtgatgagcataggccaaaagaaccggcggtatccggggggcggtctgtgcagtccgtacagaatgtgcaggatatgcaggtcatgccggaaataagactgtccaatgaaccggcggagcggctacagaaggggcgttcgggacttgggataaatgttgaaatgccgcctgaaagtcggaacgtgggcaatagtcagggtggaaaccaatattctatggagcattctatgagatcttccatggaagtcgtcaaagaatattccatgaatgtttcaaaaaccgggatggcttcgatttctggagaaacgatccttgtgtgggcgtcgggagatattttagaactgtctgtgatgtcggagctgccggaaatatcgggaaattataatgcacgggcgtgcatggtgtaatgttgccggtcacacaacaggtgtgtacagcagtgtaaaaaagaggcggtgttcaagtcggacactgtctttctttaaaaatcggacttcttttttgtgcagactgcacaagaaatttcaaatcagttgcatacgaagaatgacgtatgctaagataaatcaaagcatatttctaccatgtgaacagcgttattcagacagttgcatttgcttcacatgaccataaggatgacacatccgtctacatttcaaaaaacatttcagaaatctatgctttttattcacaaaaatgaaaagcaggagatctggatgagcctcctgcacataggaggaactgaatatgaagaagggtacacaggtatcagaaaagataccagcagccaaccgtcagtacaaagacaccgtattccgcatgttgttttcagagaaagagaaccttttatctttgtacaatgcagtaaccgggaaagcttatcagaacgcagatgatctgaaaatcgtcacgctggaaaatgcaatctacatggggatgaaaaacgacctggcatttatgttagagacgaatatttatctctacgagcaccagtccacgttaaatcccaacataccgctgcgggatctgatttacataggaatcgaatatcagcagtatgttgatgataagtccttgtattcgtcccgcctgcagaagataccggcaccgaaatttatggtattttataatggaacggatgcagtggatgaccgggtggaacttcgactgtcaaacgcttatgagcatctggctggcgagccggacctggagttaaaagccctgatgttaaacgtcaatgaaggacataacaaagagctgatggagcagtgtcagacattgaaggaatatgccatttatgtagcgagagtccgcaaatatacatcagaaatgaacttaaacgatgcagttgcacgggcaatcgatgaatgtatcaaagaaggaatcctggtggaatttcttcggaagaatcgttcggaggtaaagatggtgagtatattggaatatgataaagagtgggaagagaagaaactccgaaaggcagagtatgaggctggcaaaagtgacggaatcgagatcgcagaagagagaatgatccataatatgattaagctggatttcccaatagaaaaaattgcagaagtaactggaaaatcgccattggaaatagaacaatatttacaatcgaacagacaataaatattttaaaaagattacggaaactgttgataaaactatataaaaaaataatgaaatgaacagtaaataataaaatcctctgtaaacagaaaaacaggtggcaaatagcacctgactgtttgcagaggattttattattactatttaccaataaaaatttatcgtaaaacaataaaaatatattgcaaaagcaagatatatgtgtataataaaggaaaacaataaaaccagaaagaaaaatctggaatcaaaaacaaactcaaagaaaagtgaatcagatcaggaggagaatcatttatgcagcaaaaagaaatttcacggtggctaaaagcaatcacgattgtactggcgctgatgggggcggtgttctttctatatattatgccggtacttgcaatgtcatggagggacgcggatgaatcactggcgtatctttttatgccggggctgttgtacggctggtgcattgcggtgatctgttatgcgatcctgtaccagttctggaaagtatgtgtgcagatcggaaaagacaattcattctcaaaagaaaatgcaaaatgttttcgaaatatcagtcacttcgcattgctgctcgcagttgtgtggtttgcgggaattgtttttctggcaatcttagcggtcaggcagcccggaatcagtatttttatgatcaccgcagttttgctttcggtcatgatatctgttttggcagcggcattatcacatctgatactgaaggcctacgaattaaaacaggaaaatgaacttacgatataaggagagacaaatggcgattatcataaatatagatgtaatgcttgcaaagcggaaaatgagtgtaactgaactctcggaaaaagtaggtattacaatggcaaatatttccatactaaaaaatggaaaggcaaaagcaatcaaagtagacacattaaacaagatctgccgggcgttggactgccagccgggagatattttagaatatgttccatcggatgatgaaatttaatatattgcacggaatgaagcaggaatatgacagtttatgaaaaactgaagcaggaacaggacagcttattggaaaaggaagggagcatgaaaatggatcagaatcttacagtcagttacgaggagcagaaagcgcagtggcaggaaagaaaaaaacagcagcagaaagaaaatgcggggatttttaaaaaacttgcgccggcaagcctcatttacgcactgatctatacagtctgtatttacaaaaatatgacaggtgccgcagtacttctgtgggtggtggcaacgatcggatatatctgttacatcgttaaaacggtaaaggaaagaaaagtttttaaaacaacaataatttttgctgtgtatatgctgatccttgcggtcagtacatttacaaccggaaatgagtggatcatctggatgaattattgctggatatttgcattcacggtgtgtttcctgatacgaaatatggcagatgaaaacgaatggaatttctgggattacctgtgcggtggagtaaatgctgtatttggagcaattggcagcattgcaagaccatttggcgatggaaacgattttgcacgtttgcgggagaaaaaagaaaatggcaaagcgcgtgagatcctgatcggaattgcagtagcgataccggtggttcttctgatcggtggattgttaatgtcggcggatctggtattttcaaatatgattgcaaaagttttcgaaggaatcaggataccggcaaacctggcagggatttgtttcatgttatgttttggttttatttcatcttactgtggagtcagatatacggcatacagaaaagaccggcaggacagggaagtaaaaattcttacagagacgacagcaatgtttacggtttcggtcttagtggcggtattatatgtgatattctgtggtatacagatcatatatctgtttggcggtggcggggagctgccggcaggagtgacctatgccgaatatgcaaggcagggatttttccagctccttgtggtgtgtattttaaatctgggggcggttcttacaatggagcatttctttcagaggaacagggcggtcgatgccgttctgacggtgatctctgtatgtacgatcattatgacagcatcgagcggatggagaatgatcctgtatatccgggcataccagctcacatttttgcgtgttgtggtacttgtggcactggcagtgatcacgcttctgatggcagggacgatctgttatatctggaaccgcaggttcccgttatttcagtatggaatggcggttgtgtgcgtcagttatgtcctgtttgcctttgcacatgtagatgcggggattgccgcctatgatctggcgcagatcgaaaatggaaatactgcgggagattacagttatctctcctgtttatcaacggatgcggcaccagtgatcgctgagtacttaaaagaacatccggacaagagttattacggggatggaatatataactggaagtgggaatatatgcaggaaaatgacaggatgaaccagcctgtgacgctccggacatttaatctgtcttatctgcgtgcaaaaagaatattttcagaaaaataggtcataagtatcagattattgtcataaaaataatatttatttacaaatgttctccggttttgtataatgaaacaaagatgttgtgaaaatttatgatgaggagaacaaaagatgaaaggaaaaacagctggaaagataattgcactgtttgccgtggcgggaatgctcgccgggtgtggtggaaaaacaggtactacgccggatgattatgcgacaaacgatggctatattacaacggaaaccgccgggaacagtacaggcggtgcacagtcggataccacatcgggcacggcagggatttcgaaagaaaatataaaagtcggcgtgctttatatttcagatccggatgagggaagcggatattcttacacgcatgatctgggaattgtgggaatgcaggaaaatctgggtttaagcgatgatcagattgagagaaagatcgtggatgactctgacgcaaaggcgacggaggaagcaatcgaagcatgtatttcggatgggtgcaatattatttttacaaccagctgggggtatatggaaacaacagcagagatggctgaaaaatatccggatatttacttttcccatggaaccggttatatgtcaaatggaaagaacttcaacaattattttggtcgtatttaccaggtaaggtatttaagcggtatcgtggctggcatgaatacaaagtcggataaggtcggctatgttgcagcgcaggattcttccaattcggaggtgacaggtggaattgatgcatttgcgatcggtgttgcagctgttaacccggaggcaaagatctatgtggcagtcacaaacagctgggatgatccggataaggaaaaagcagcatcggaacagctgttggatatgggctgtgatgtgatggcacagcattgtgatacgccgtatccgcagacactcgcacaggaacgtggtgtatatggtatcggctataactcagatatgagcaaggaaacaccggatgcctgtctgacgagtgttatctggaactggagtgcatactatacttcggcagttaagagtattatcaatggaacctgggatggatcaaactattatggaggtatggcagaggggctggtacagctgacgaatctggcatcttttgcggcagagggtacgcaggagaaggtggatgaagcgactgcagaaattttaagtggcagcaataatgtttttgacggagtgatggagacaaatacaggggagacggttggaacagagaatggaaccttagatgatgcaacgattaccggcggcattgactggtattataaaaacgttgtgattgtggactagggggagaatgagatgatgaaattgacgattcgaaaaaaagttttattctgttctttgataccgctgcttctgttaggaggaattatccttctgatcgcgtccacgatcgtaaagggtgcaattatcgatcaggtggaaaattcattaaaaggaactgcaatcgcgacgcaggcagcttatgaccagaatgcaggtacctatttgcagacggaaaatggtgatatctggaaaggaagttataacatttcacagtcagagaatctggtggataccatcaaacaggagtctgggatggatgtgacatttttctatggatcacagagaatcatgacttctgcagtcgacaaaaatggtgacaggattctgggaagtccggcgggtgacaaggttgttgaaaaggtattaaatggtggtgagggatatttcagtgataatgtatccatggatggcatcatatattatggctattatgttccggtataccagaaaggtgataatacaactccgattggaatggtgtttgccggagcagaaaagcaggaaatctcccatagtgtgatacagatcattaatacgatcgtagccatcgtgcttgtggtacttgttatctgtatcattatcgtggagatcagtgcaacctcgatcacacgtgcattaaagaaaggaattgcaaatgtgcaggaagtgtctgccggtcatcttgacgtagagtttgacaagaagatcttagggcggaaagatgaagtcggagatctgaccaaagcgatacagcatttacagaaagaactgcaaaagatcattaagggaatcaaggaaagtaccgatatgctgatggaagcatccaatactttagaggatacatcccatcagacttacgatggaatgcgtgaggtggaggcaacggtagattctattacaaccggggcaaatttacaggcagaggatgcaaaaaaagcttctgacaatgtaaaatatatgggaaatctgatcattgagaccggcagagcagcagatgagctgaatgaaagtgcagatcagatgaaacagtccagtgatgcggctgttgttacgatcgatgaactaaaacgaatcagcgaagaagtaaaggcagctgttgcaacgatcgcggaacagacgaaacagacaaatatttcagcacagagtattcagaaggcatcgcagtttatttctgaaattgcatcccagacgaatctcctctctttaaatgccagcattgaagctgcgcgtgcaggcgaggctggaaaagggtttgcggttgtggcatctgagatacagaagcttgcagaacagtctgatacggcgagtggcaatatcggcgaaatcgtaaatacactgatcggaaactcccagcgtgtggttgagacaatgggcaagacacaggagatcattgaaaaacagaatatgcatatcgagagtacggagcagatggtaaatggtgttatgggtgagatcgacgcatctattgaacgaattcgccagattgaaacacgtacaaagaaattagagagtgcaagaacagagatcatagatgtcattgattctttgtcagagattgcacagcagaatgtggaaggaaccacgcagacaagttcatccatcacagagattacggacagttttcagaatatcaaggattctaccgaaaatctgcgtaatatggcggatatgcttgcacacaatatcagacattttgatatatgataaaaatatggccttaagctgcagaatatggagacaaaacagatggaagtgcttgctgtttttgacgagaagaattatgacgacacaacaaaagtatatgaaaaatataatgtgcgtggtgtaattttccgggatggaaagattgccatgcagtgcagtacggatggcgaatataagatgcccggcggcgggatggaaaagggagagagttttttagaaacccttgtgcgtgagatccgtgaagagacagggcttaccgttttaaaagagtctgtgtgtgaactaggggagatccttgagatgcgccgcgatatatttgatccgtcctgtaaatatatctgtcattcttacttttattactgtaaggtaggggaaaaacaggagaaacttcatctgacacccagtgaagtggcaaaggggtattatcttaagtgggagcagccggagactgtatacaataccaatatacgcatagaaaaggatccgtggatcattcgtgacactgcatttgtgaagatgattctggatggaaaagtaaaattgccggaataaaaaggcaaagaagaaatccggtacataaaataatagaatgtccgcggagcgcgcattctattatttttttgtggaagaacgacaaaaaatatgttatacttaacaatatgtattgcagaaaaactgatctgatatgcaatagataaaggcacagataaatgacggaggatggcgcatatgaatgaaaattatgtaacacttaccattggaaaacagaaaaatattgcactgatcgcgcatgataataaaaaagcagagctgatcgcatggtgcgaaacaaataaagagatcctgaaaaatcatttcctttgtggaacagggaccacggcacgtatgattacagaccagaccggacttccggttcgtggatataacagcggccctcttggtggagaccagcagatcggtgcaaagatcgttgagggaaaagtagactttgtcattttcttttctgatccattgactgcacagcctcatgatcctgatgtaaaggcactgcttcgtattgcacaggtatatgatatcccgatcgcaaacaataaggcatcggcagactttatgatcagatctgaatatatgaatgaagagtatgagcatgaggtgatcaacttcaaagaaaacatcaaaaaacgctcagagacattataagggggaacatttttcatgagcaaagtagcaatcgtatcagacagcaacagcggaatcacgcagagtatggcaaaggaacttggagttaccgtgatgccgatgcctttttttgtgggagacaagacactgtatgaagatatcgatctgtcacaggaagagttttaccagatgctttccgagaagacagacatccatacatccatgccgcttgtaggaaatgtgacagatacttgggatgaattgttaaaagagtacgatgagatcgtacatatcccaatgtcgtccggacttagtggttcctgtgagacagccatgatgctttcccaggattatgatggaaaggtgcaggtggtgaacaatcagagaatttctgttacacagcgccagtctgttttagatgcacttgcgcttgcaaaacagggaagaactgcatctgagatcaagacaattttagagcgtgataaatttgaatcatcgatttacattatggtggacacgctgtattatctgaaaaaaggcggcaggatcacaccagctgctgccgcgcttggaacactgttaaaattaaaaccggtgcttcagattcagggtgaaaaattagatgcatttgccaaggcaagaacggtaaaacaggcaaagagtatcatgattgaggcaatgaagaatgattttgccaaccggtttaacgatccgaacggagagcatatgtatcttgagatggcatatacgcatgatttagaagcggcagaaaacttcaagaaagaagtgcaggaggcatttccggggatggagatccgtatggatccgctttcacttagcatttcctgccatatcggaccgggagcgttagcagtggcatgttcaagaaagattccagagctggaagcgtaatagaaaaataaaagagaacagagagaaaagccagataaagcaatcgcctgaaatctgaattacaagagataattcggatctcaggcgatttttacctatagaaattaaaagtcctttgcagacagaaaaatttcacgctgtttaggctggagaactgctgtgctgccgtatctttttgcttttccaaatgatataagtgatcatcagaggaataccggcgcccacccaggcagcaggatcagcaaggcagatcccctgataaccgagtggtttctgcaggagtgcgatcgcaataaagcggcataccagctcgatcacgccactcaacattggaacaagtccttcgcctaatccctgtaaggcattgcggtataaaaagatcatggcaagcgggaggaaaaaccagcttacagtttttaagtacatcattgcataggagaaaatttcatcggaaggattacttacaaaccagctcacgataaattctccaccgaaaatacagatggcagcaccgatggctgctgcagcgatacagatgaaaaatcctttgcgcataccgtcgaaaatacggtcgtattttcctgcaccgagattctgaccacagtaggttgccatggcggtgccgagcgtcggcatggtctgagttgcgatattgttgactttagaagcggctgtaaaggaagcaaccacactggaaccaaacacgttgacagcactctgtaagatcatggttccaatggcggtgatggagtaatttaatgccattgggataccgatcgagagcatgttaatgacacccgggcgatccagataatagtccgcttttgttgtgcgaaggatctcaaactgccggaacatatggataaaacataaaattgcggagattccctgcgcaatgatggtggcataggcggcaccggcggttcctgctttcagtacgacaataaataaaagatccagtaccacatttaatatagaagaaatgatcaaaaagtagagcggtgttttgctgtctccaatacctcttaagataccggcggatacattgtagagcattgttaagatgatacctgcaaaaatgaccttgatgtaagcatctgccatggataagatattatccggtgtatgcatccagactaaaaacaggcgggaagcggcaacggtcggaatcgtaagaattgcagatacgatcacggttaagatcagggagagtgcaacgtagtgttttaacaagcgaaaatcttttgcaccgaaggcatgcgaaatcatgacaccaaatccctgtgcgattccggtggcaaagccgagcactaaaaacatgatacatccggtggaaccgacggcagcaagtgcatcttcgccgaggtatcttcccacgatgatcgtgtctaccatattataaaattgctggaacagatttcctaataaaaccggaatggaaaaaagcagtatgatttttaatgaactgccggtggtcatatcttttgtcatgctactggaaactcctttcaaactttggtatgatgtaattattcagtgcacatatatgcagtataatgtaataaacatgtaaggcttagtatacgtcacaaaaatcagaaatacaagcggaaaataagactttttttctaatttttttaagggagaatcagatggacattaatttggaatactataagatattttattatacggcaaagcagaaaagtgttacgttagcggcagaaaaactgtcaatctcacagccggcagtcagccaggcgatcaagcatttagagaaggatcttggctgtgcattgtttgtaagaacggcaaagggagtacgtctgaccaaggagggtgagatgcttttttcctatgtggaacgcggctatgaggcgattctttccggagaaaaaagacttcttgagatgctaaaccttgaaaagggagaaatctgcatcggtgcaagtgatatgacattaaaatattatctgcttccatatttagagcggtttcatgaaaaatatcccaatatccgcgtgaccgtgaccaatgcgccaacaccggaaactttacagcatcttgcggatggcaggattgattttggaatcgtgagctctccggtggagccgcagggatggcttaagatcatcccggtcaaagagatccgcgacgtttttgtggcagggaaaaaatacaaagagctctgtgggagaaagatgcaatacaaagaactttcggaatatccgctgatgtgtttagagggaagcacctcgacgagacattatgtggaggcatttttagaagaagaaggtgtgacggtgtccccggaatttgaacttgccaccagtgatatgctgattcagtttgcgctccgcaatcttgggatcgcaagtgtgatggaagagtttgcaaaagagtatgaggaggatggcaggctttttaagctgcagtttgaaaaagaaattccggcacgaaaattctgtatcgtattaaatgagaggatcccgatgtctgcggctgcggcaaagcttttaaaaggacttttataaattcacataatgaatgattatatcagatataaagaatattaattttacttatagagaaacatcatgtataatcagtaagtaaacaggaatagcatagagaaactaggaggatattcaaatggtaaaagcagtcgttggagccaactggggcgatgaaggaaaaggaaagatcacagatatgcttgcgaaggaagcagatattatcgtacgtttccagggtggtgcaaatgcaggtcatacgatcgtaaatgattacggaaagtttgcacttcacacattaccgtcaggtgtattttacggacacaccacaagcgtgatcggcaatggtgtcgctttaaatattccggtacttatgaaagagatccagtctatcgtggagcgaggcgttccgaagccaaagattttagtttcagaccgtgcacagatggttatgccttaccacattctgtttgaccagtatgaggaggagcgtttaggcggaaaatctttcggttccacaaagtcaggtatcgcaccattttactctgataaatacgcaaagatcggtttccaggtcagcgagttatttgacgaggagctgttaaaagaaaaagttgtccgtattgcagagacaaagaatgtactcttagagcatttatatcataaaccactgatcaacccggatgaattattagagacattacatgagtaccgcgataccatcgcaccttatgtatgtgatgtttcttcttatctggatcaggcaatcaaagaaggaaagactattttattagagggacagcttggaactttaaaagatccggatcacggaatctatccgatggttacatcttcctctacactggcagcgtatggtgcaatcggtgcaggtatcccgccatatgagatcaaacagatcgtgactgtatgtaaagcatactcttccgcagtcggagcaggtgcatttgtcagcgagatcttcggtgatgaggcagatgaactcagaagacgcggtggtgacggcggtgagttcggtgcaaccacaggacgcccgagacgtatgggatggttcgactgtgtagcaagtaaatatggctgccgtctgcagggaaccacagatgttgcatttaccgtactcgatgtacttggctacttagatgagatcccggtatgtgttggatatgagatcgacggtgaagtgacaacagatttcccgaccacagcaaaattagagaaagcaaaaccggtattaaagaaccttccgggatggaaatgtgatatccgtggaatcaagaaatatgaggatcttccggaaaactgcagaaaatatgtagagttcatcgaggaacagatcggctacccgatcacaatggtttcaaacggaccgggaagagacgatatcatttaccgtaccaaataggaaaaaggactatccgatatgataaaaaatattatttttgacgtaggaatggtgttagtcaactgggatccgcatgcggcgtttcaggagttaggttttgatgaaaagacagaggaggcggttggaaatgcgaccgtttactctgatgcctggaatgaatcagaccgcagtgttctggatgcagaggagcagcttgctgtatttgtccaaaatgcaccggaatatgaaaaagagatccgcctgttctgggaaaatgttgcacgggcaatttatcagtacgattattcgcgcgcatggatccgggagctgaaacagaaaggttaccatgtgtatatcctttccaattacggaaaatggacttatgaacatacagcggaagctctttcatttctttcggatgtggacggacaggtattttcctttgaagttcatcagatcaagccggaaccggagatctatcggacactgttagacaaatttaaccttgtggcagatgaatgtgtatttttagatgaccgcagggaaaatatcgaagcagcggaaacacagggtattcataccgtgttgtttacgacgtatcaggatgctttggaaaaattaaaaacatatggtgttatgtaggaaatggtacatgactgcataaaatcgtatcacaggaagagatacaggataagagcagctttcacggatgtggaggctgcttttatttatgataatagaatgctcgcagagtgtgcattctattattcatgacaatagaatgctcgcagggtgtgcattctattgtatatgttcacacttttatcacagattcatcctcctttaaacacaattacacgttactcttataaagtaataatttggttactggtcacacgataagtgcggatagtggcatatattgagaatgaaataaggaggagagaaacgtgattgagatcaatcatctggtaaaaaaatatggcagtcatgttgctgttgatgatctgtcgctcacggtagagccgggtaaaatctatggttttctgggcccgaacggagccggaaaatcaacaacgatgaacattattactggctaccttgcagcgacatctggtgaggtaaagatcaacggatttgatgtgttaaaacagccggaggaagcaaaaaagtgtgtggggtatctgccggaactgccgcctctttatatggatatgacggtaaaagaatatctggattttgtggctgaattaaagaagttagagaaaagcctgcgggcaggatatgtgaaggaagccatgaaaattacaaaaacagaggaagtatcgggaagactgatccgtaacctgtcaaaaggttaccgccagagagtcggttttgcgcaggcagtacttggatatccggaaatactgatcttagatgagccgaccgtaggattggacccgaaacagatcatagagatcagggatctcatcaaggaacttggaaagaaacatacgatcatactaagttcccatattttgtctgaaatctctgctgtctgtgatcatgtatttattatttcgcacggaaaactcgttgccagtgattccacggagaatctgttagagcggatgaccggtgcacaggagatcgagctgctagtgaaagcagaggaagatactgcggaaacagcgatccgtgaggtcgcacaggtggagcggtgtgaaaaaacagagtcgaaagaggatggcgcggtacagcttcttgtgacggcaaaaaaagatgcggatgtacgcgaggcgatttatcacacctgcgtggaacaccatatgccgatcttagagatgaaggcagcatcgaagtccttagaggatgtattccttgaactcacatcacaggaaggaggaacaaaataatgtttgcaatttttaaacgtgagatcagatcctatttccagactgtggtgggatggctttttattgcagcagtactcgctttatatggattgtatttttatgcttataacttgaggtccggttcgccttatgtttcgtattcgctttccgcagtttcatttattgtgatgattgcggtaccggtacttaccatgcggagctttgcggaggaacggcatacaaagacagatcagctgatgttaacttccccggttccgcttggaaagatcgtgtttggcaaatatcttgccatggtcggagttttctccattgcaatgatcgttgttgcgctgacaccgttatttttatccatttatggttctgtgccgctaggagaaagctatgtggcggttttgggattctggctgtatggctgcgcatgtattgcgatcggtatgctgatgtcagtggtaacggaaagtcaggttatcgcagcagtgcttggatttgtagcactgtttcttggttacatgatgtcgagtattaccagcatgatctcacagagcggtaatcttctgacaaaaatattaaacgcatatgatttgtacacaccgttggataaatttatgaatggctgcttagacctcacaggcgtgatctattttctgtcggtgatcggaatctgcctgtttttgagctgccagctgatccagaaacgcagatattcggttagcaccaaaaagatcgctccgggggcgttttccatcggaatgatcgttgtcgcctttgccattgcggttgttgtgaacctggtggcaaatgagctgccgtccacggtcacagcaatcgatgcgacatccacaaagttgtactccatcacggatacgacaaaagattacttaaagacactggatcaggatgtcaatatttatgtgcttgcagcagagaaaaatgcggacagtacgctttcagagacattacagcgatatgaggatctgtccggtcatgtaaaagtaagctatgttaatccgtcgaccaatccgacatttttccagaagtatacgacggatgcacctgcttcgaacagtctgattgttgcgagtgatgcacgctccagagtgatcgattataacgatatttatgagtactcctatgattattcttcctattcaagaagccttgatggatatgatgccgagggacagatcacaagtgcactccagtatgtgaccaaagattcgagcgagctgccggttgtctatgagatcacaggacacggggaaacttcgctttccggcggattttcggaagcaatcgagaaggcgaatatgacactcacggagctgacattgttaaaagaggaggctgtgccggatgatgcatcagcaatcattatcaacgcaccgacttcggatttctccgcagatgatgcaaagaaagtgaccgattatctggaaaaaggcggaaaagcgctgatcacgaccaatttccagtacaaggatctgacgaactttgaaagtattttaaaagcatacggcattgagcgtgtggatggtattgtcatggagaacgacagttcctactattacaataacattccatactatctgcttccggaagtagagagcaacgattacacctcttctgtcagcggaaaatatatttttgcaccgtacagcgaagcgttcagttatgacgggtcttccgatgatgtgacatataccgcattgctgcagacaaccgataaggcggtatcaaagattgatgcagataatgcaacaacatctgaaaaagaagacggagatattgaaggaccatttacgatcgcacttgcggcggcaaagacagaaaatgatacatcatcccaggtcgttgtggcaggttctatggagttatttacggattccacagaccagatcgtatcgggaagcaacgtatcgatgtttactgatatcatgacgaatctgaccagcggggaggatgataataccagcgttattccggtaaaagactataagatgagcacgatcacgatcacttcaatttctacaattattggtggactggcagcaagtatttttataccggttgtactgattattatcggagttgtgatctgggcagtaaggaggaaaaaataatgcagaaacagaaaaaacagatgatcgttctggtcattttgctgatcctgctgatccttgcgtatataggcgtccatttttacagtaaaaaacaggaagaaaaggaaaatgccaaagaagaggcggaaaagatccaggtgacggatcttgaggtctctgatatcacacagttttcttatgtgctggatggaacaacactttcctttacaaaaaatggaacagagtggacctatgacggggatcagtcggttgatattgatgagagcgctttggagacacttttaaataaggcatcagcgatcacggcatcagacgaggttacagagtatgatgacctggcggactttgggctggatgatcctgctaatacggttacgttaaaaacggattccgggctaacgacgatctacattggcagccagaatgagatcacgaatgagtattatctgaaaacgggcgacagtgataccatatatgttgtggacagcgcgccagcgaccggatttgataagagcgtcgaagatctgaccgcaaaagcagatgatacggaaactgaggcagaagagccatcggaggccgtggatgaaacggagacagcgaccgtggtgccgaatgaaacagaggccgttgtaacagaggaaacgaagtaagagagtgaaatgacaaatctgaatcacagagatgaaaataccggattgtatatgtgcagtccggtattttaagttcataaatttttaatttgacacttttggaaaaaagaggtaacatgaatgtgagaaagttcattaacgaactaattcgaaccgcaaagcaggaaataaaaagttatttaccggaagaaaaagaatgtggagcagggatgatgtacagtgagtatgaaatatttggaaccaaccagcagatgagaaaagtgatcgagcaggcatgtgaacggctgatggagacctatggattgcgccatgtggagctggatatcctttatctgatttcccatgagaaacagaaggataccgcaaaggatctgatcgagatacagcatttgtccaaggcccatatttcaaaatcggtggacaatttaaaacagcatggatatattgagctggttgctgatgaggcggatcacaggaaaatacacattcgtatgactggtaaggcaaaacctgtgctggaagagtttgaacagatccgggcagatattttagagcgtctgtttgcgggcgtgacagaagaagaacgaagctgcttaaagcgggtaatgggcaagatcatgaagaatattcaggcagaacaggaggatgggacatgaaccaatatggagattttggaaaagaaacggaagaactgatgacaatatgtgaacgtaatgacagaatcccgccggagctgtttaaggagttcggtgtaaaacgtggtttgagagatgtggatggaaccggtgtgcttgcggggatcagcaatatttcaaggatcgatgcgtttaaaacggaggatgggaaaaaggttccgtgtgacggacagctctggtaccgcggttacaatgtgatcgacctgatccatggatttgagggaaaacgttttggattcgaggaagtggcatacctgctcttgtttggcgaactgccggatgctgcaaaattaggggcatttaagagcatgttagaagagtgcagacagcttccgacaaactttaccagagatgtcattatgaaagcaccgagcaaggatatcatgaattcgctgacgagaagcgtgctgacacttgcttcctatgatgagacgatcgctgaccaggagctgcatacgcagttagaacagtgcatcaagctgatcagtgtgttcccgatgcttgcggtgtacggttaccatgcatacaaccattatatctgtgatgacagcctttatatccaccgtccgcaggagggattatccgcagcagagaatctgctccttatgcttcgcccggataaagcgtacacggaactggaagcgcgcgtgcttgacattgcgctggtacttcatatggaacacggtggtggaaataactctacgtttacaacaagggttgtgacctcatccggatccgatacatactctgtcatggcagcggcactttcttccttaaaaggaccaaagcacggcggcgctaatatcaaagtagtggaaatgatggatgatatgagaaatcatgtgaaggactggggagacagagacgaagttaaaaactatttggaacagcttgtcgacaaacaggcatttgaccgcaaaggcctgatctatggtatgggtcatgccgtttattctctttccgatccgagagcgcgcgtattcaaaagctttgtggaaaggctcgcggtggcgaagggaagagaaaaagattttgcattatacagtatggtagaaaatcttgcaccggaagtgatcgcggaaaaacgccatatctataagggggtttcagccaatgtggacttttacagtggatttgtatacagtatgttagacatcccgttagagctttataccccgatctttgcgatcgcccgtattgtcggatggagcgcgcaccgcatggaagagctggtaaatatggataaaatcattcgtcctgcataccggagcatcatgccggagaaagcatatgtgccgttagaagagcgataaaaaaatgagcagaggaaaattaatcttccttctgctcatgatttttcttgaccatcttatatacaaaagaatatgcccagatcagcaccgggatgatcacggttgcataaacagaggccatcagcatatccatatagttctcattggaagagagtgcacagacgatggtggaaatataaagaccggctaagataattgcgccaagaatggcaagaatacgttttatttttttcaaatccaaccctccagtttttagtgtacttatcggcatattgttcgcaaaatgccggaaatatattaagattatcctagccgaaagtgacggaagagtcaagatgcaaacatcgtgaacagagattttactttaaaaaataaaagcccctgaaagcatgtcgaaaagactgaaaaactgtatcagtggaaggattccaaaagttgatgcagtccgcgaccttctctccagaataaacccggatgaaatacgcagcatacatgaagaaatgattgatatcataaaacgtaaccgggtattccgggaaggaacgataggcggatagaaaatcagcagaagaaatatatagggaaaaagcagggggaattttgcgcgtattgaccaggaacgaagggtaaccgcagatggaatgctgataactggattatttataaaaatgcatagataaaaaagttaaaagcgaaatccctgcatcgtgaattaatgaattgcaaaaacagcagatatttgctataataatatatgcatgttaaatgcaaccacaattcacatagaaaacgaggaaacagactatggcattattagaacagtggcagaaaattgcctataatgagaaaacagacagaggggaattacagagattctggcagagatatttccttttggaaaaaggcgtatatgagaagcttcttacgaacccggatgagaaggtcgagggaacggtaaaagagcttgctgataaatataatctgagcgtcatggagatgacaggttttctggatggaatcaatgacagcttagtagagccgaatccaatcgataccatggaggaggatacaaaagtaagccttgcatttgacaaagaaaaattatacaaaaacatggtagatgctaaggctgactggctgtatgagcttccacagtggaatgagatcttcgatggcgaaacaaagagaagactgtacttagagcagaagaagtccggaactgttattgtcggaaagaaaatcggacgtaacgatccatgcccatgtggatccggtaaaaaatataaatactgctgcatgaataaataagaaaaacaaaatcccggtgctttgaatgatatcagaacacagggatttttatgtatctgaaaggagaaattatcattatgaaaaaaataaaagaattttttgcggatatgacggaaactgtttctgtcacaaaattggatggaactttgatcgttgcgatcgcagcgctttccggcgtgatcatcgggatgctgatctcaccgcgcaaaaatgcaaaatatggctgtggtaacggtacgacttatattaccaacaatggagaagatgactgggactgggatgacgaggatacagaataaaaattgtcataaaaaccagatattgtcataaaaagaaaacctgtaaacgctgtttcaaagcataaatcagacaaagggagagagaataatacaagacagtcagatcattacggaagaaatgataaaaatacgaaggactgtcccctttttcatgagggagaaaaggagaaaaaatgacaattctggattgttcggtaacaggctgtatgtacaacgaggcaaactgctgccacaaaggtaatatcaaggtggaaggagaagacgcaaaagaaagtgaagatacctgctgcggaagttttgcggaacgtggggaccgatgcgcaaaaaacgtaacgggagatgcaccgaaaaatattgaagtggcatgttgtgctgcgaactgtgtctttaataaggaagagaaatgcagcgcagaccatatcggtatcgcgggtggtaatgcctgcaactgcagagaaacggaatgcgcaagtttctgctgcggctaagaagtttttgcgccagcggtaacaaggacggtaaaaccggagattttgtatagaagtctccggtttttcttatagcggaatctttagaaatctgacataaaatgcacagaaaaaattcaggtaatcttaacttgtattttggttagatgagacttataatgcgaatagaaaataagtcatagaatacatttctgagtgtcaggaatgcataagaatgggaggcttttagaatgagaaaaaaatctcatatttcgcttgcaagatatatcgtaaacagtctggatgacaaagagttaaaaaaacacaggttttcattttatatcggaagcgttcttccggatatcaagccttcttttatttacaaaagacatgagatcaatggaacctttccttatgtaaaaaaacatattgcccggctgtcggaagggcagaaggtcatgaataaaaagaacagaaaatactatagagatttaggacaggtcagtcattatctggcagattattttacatttccacacaacaaaatatatccgggaggatttaaggatcactgctcctatgaggaaagactgaaacgcgatttgagatcctatatcaaaagcggagaggctgagaggcagcatatttccggcggacattttgtggatgcgaaagcactctgcgattatatccagaaagcgcatgatgattatattgaacgaaaacatgatgtcgcagatgatatcacgcatattgttgaggtaaatcgcagggcaattgagggaatgatagaagttcttgcgagaaagagcgaaaatcaccgtctgaaacactcataataagggaaaacatggcatctggtgtcgaaaaatggtgagaagtggcatgctgttttgattgatttttgcatgatttaggagtaatatgtaaatatcaacgaaaacagtatcataagtactataaaacgccagcaacgcgatgaaagtggcataggaatcttggcagtcaaggaggattcatatgaacagaatcgaagaaattcaaagagaaattgagtctgtccggtcagaactcaatgaatcatttttacagaacgatgaattcgaggaatactatcgaaagagtacggaactggataaactgatcgaagaatacttagagagaaaacagcaggtacagatgagctgacagacaggcgaacaggaaaaatattattttaagaacgataggacaaaggtactaccgttctttttttgtgcaacaaattagtaacattaccgcaaaaagccgttggaaaatcaaggaaattcttgattttttcttaagagtggtttaagatgtatataaatgtggaggaaagtggtacaaaatggtgtgaagtggtagatgagatcctgtttggtggaagatcagatctttcggattttagttccactgaaaggcaggtgtttgtgttatgttcatgggagaatacaatcacacagtggatccaaaaggcagactgattatccctgcaaagttcagagaacagcttggcgatgaatttgtagtgacaaagggattggatggatgcctgtttgtgtatacgaaagaagaatggcacaacatcgaggaaaagttccgggggatttccatgacctctaaggacgccagaaagttttcacgttttttcttcgcaggagcagcggcattagaactggacaagcagggaagaattttacttcctccggttttaagagagtatgctgatttacaaaaagatgtcgtcttagtcggcgtgttgagccgtgtggagatttgggataaaggcagatggttagaaaatacctatgacgaggatgagatggatggcatcgcagaacatatggcagagttgggatttagcatttagaggtgagggcagtggaatttcatcattattctgtattattgaatgaaacaattgaaaatttaaatatcagaccggatggaatctatgtggacggaaccttaggcggtggcggacattcttaccagatattaaagcgtctgggagagaatggaagactgatcggaatcgatcaggatgcagatgcgattcaggcggcaggcgaacgccttgcagagtttggaaacaaagctacactgatccgcagcaattatgccaatatgaaagaagaactgcatgcgatcggagtgaacggggtagatggcatagtgcttgatcttggtgtttcttcttttcagttggatacaccggaacgtggattcacctaccgtgaaccggatgcaccgcttgatatgcgtatggatgacagacagagccagacagcgaaagatatcgtcaatggctacagtgaaatggacttataccgtattatccgtgattacggggaagataaatttgcaaaaaatattgcaaaacatatcgtaaaagaacgacagaagaaaacgatcgagacagcgggagaattgacagatattatacgcgcagccattccaatgaaagtacaggtgaccgggggccatccggcaaagcgtacatttcaggcgatccgcatcgagttaaaccatgagcttgaagtgctcagtgatcacttagacgagatgatcgatctgttgaatccgggtggaagaatctgtattatcacattccattcattagaagaccggatcgtaaaatctaattttaagagaaatgagaatccatgtacctgcccgagtgatttcccggtgtgtgtttgtggaaaagtgtcaaaaggaaaagtgattacaagaaaaccgatccttccatcggagaaggaactggaagaaaattcgagatcaaagagtgcgaaacttcgggtgtttgagagaagataaagcagggaggaattaacatgaagaatcagacagagaggagagcttccgaaagaaattactatgtggatggcaatacagtgcgccgcatggaagcagtgcctgattaccgaagagaaagacgggaaagagaagagagagaacgggaagaacagctgcgcagaagaaaacgccaggtaagaagaaatcaggaacgccagcttcggatgagcaagaggtatgtggtattccttacaatggcagtgacagtgtttggcgtgtttgcaggtacttacataaaaatacagtctgatatgacggcaagaatgaatacgatcagcagcttagaaagccagatcgctgatttaaaggcggacaatgatgaggcatataagagaatccgtatgtctgtagatcttgacagtgtcagagaaaaggcactcaatgagcttggaatgtcatacgcaaaagaatcccagattatctattatactgttgacaatgatgattttatgaatcagtacagtgagataccgcagaaatagcagagagatactgacataagaaatgcaggggtaaggatggcagcaaagaaaagaagaaaaccatggttgaaatttccaaaacgcatgcagaaaaaactgatcgttatgttcagtgcgatcgcagttttgctgacaggcctgattggaagacttatgtatattgaatataccagtggtgataaatatgagaaaattgttttatcacagcaggaatatgacagtcagaccattccgtatcagagaggcgatattgtggacagcaagggcacggtacttgcaaccagtatcgccgtttataatgtcattttagactgttccgtcatgacaagcaaagatgagtatattgagcctaccattcaggcacttgcaagttgttttgaggacttagacagcaatacactgtatggctatgcaaaagatcagaaagacagccgctatattgtattgaagaaaaaagcttcctatgaggaaatacagccgtttgttgagatgcaggaggctgttgatgaaaaaggaaaaaaggtgaatcctgacatcaagggtgtctggtttgaaaaagaataccagagagagtatccttatggtgcgctgggaagttctattgtaggatttacggcttccggtaacgttggagtgaacggtctcgaacagtattacaacgagacattaaacggtgtggatggcagggaatacgggtatttaaacacagataataactttgaaaaaaccatcaaggccgcaaaaaacggtaacacggtggtatctacgatcgattctcatatccagtctgtagtggaacagaaaattgcggattttaacgaggcctataccggaaatttccgcgaggatgagccgggagcgagtcatgttggtgtgctgatcatgaacccgaataacggggatgttcttgccatggcaaattatcccaattatgatctgagtaatccgagggatctttcggcgtattatacgcaggaggagattgatgcgatggatgaagatgcacagatggatgcattaaaccagctctggcagaatttctgcaccacatatacctatgagcccggatctactgcaaaaccgtttacagtagcagccggacttgaaacgggaaaagtttcaacaggagacagtttttactgtgatggatatgagcatgtgggaggacatgatattcactgtgtaaacagaagcggacacggaatggaaacgcttgaacagacgcttatgaattcctgcaatgatgcgatgatgcagatatcctaccgtctgggaagtgatatttttacaaaatatcagcagatcttcggatttgggcagcggacaggaattgaccttccgggagaagcgcgaacagattctttgatctatacggcagataatatgggaccggtcgatcttgcaacgaatgcgtttggacagaattttaatacgacgatgatacagcttgcaacggcgtattgttccctggtcaatgggggaagcctttatcagccgcatgtggtaaaacggatcacagatgaaagtggaaacacgatcagcgaagtgacgccgactcttctgagggaaacggtatcgaagtcaacgagcgatgctttaaaacagtatatgtattctacggttacaggcggtactgcggtaactgcaaaagtggatggatattccatgggaggaaaaacaggtactgcgcagaaagcgggacgtgacggggtgaactatctggtttcatttattggatttgcgccggtcgaggatccgcagcttgtcatttactgtgttgtggatgaaccgaatgtcgcagaacagttccacagtacttatgcacagaatattgtaagagagatcttagaggaagttcttccttatatgaatatataccgggatgaagatactaccggtattcatgaaggctggggaatcaagggggaagatgaaggagatgtcggtgatgtgacggcagcggatgttgcgaattctactgccgaggagagtctggatgtgccggatacgacggatgaactgccggaaaatactggggaacagcctgccgaagatattgatccgggatcagatgaaggacagcagtagggaaaagtataaaacaaaacacataacctcacaaaagtaagaataaaatgctatgaaaacttttgtgaggtttttgtatatgcagcagggacttcctttctatagaagtaagacatttcatcgtaaaaaaatcatggtgatgtttacagccgtgttcctggcacttttatttttgatggggaggctggtgtatcttatggtgttctgttcggaatattatggacagaaagcacagaacctccatgagagggaacgtgatattaaggcggcaagaggaaaaattttagatgcaaacggaatggtgcttgccacgaacaaatcagtctgcaccatatcggttatacacagccagattgaagatgaggaggcagtcgtaaaagcattggtaaaagaacttggactgtcggaggaggcggtgcgaaaaagagtggaaaaggtaagctccatcgaacgtgtaaagacgaacgtgcccaaagagacaggggataagatacgggcatacaaacttgcagggatcaaagtcgatgaagattataagagatattatccgtatgatacacttgcatcgaaagtattaggatttacaggtggtgataatcaggggatcgtcggacttgaagtaaaatatgattcctatcttcagggaacgaacgggaaaatactcacgcttaccgatgcgcggggaattgagattgaaaatgccggtgagacgcggcttgagccggtcaatggatacgaccttaacatctccatggattataacatccagttatattgtgagcaggcggctgagaaaacctatatcaaaaaggatgcaaagtatgtgtctgtgattgtgatgaacccgtcaaatggagaaatttttgcgatggtaaattatcccgaatttcatctgaatgatccgtttacactgacggaagaggtaaatgtcccggcagagaagaaacaggatcttttaaatcagatgtggagaaaccagtgtatcagcgatacttatgaaccaggttcaacatttaaaatcatcacagcggcagcagctttagaacagggtgttgtgaaactgacagataatttctactgtcccggatataagctggtggaggaccggcgtatccggtgtgcaaaaacaaccgggcatggagcggaaacatttgaaacggggattatgaactcatgcaatcctgtttttattgagcttggagaaagacttggagttgaaaatttttataaatatttcagccagtttggactgctctcgaaaacaaatgtggatctgcccggcgaagctgcaacgatcatgcataaaaaagaaaatgtcggtccggtagaacttgcgactatatcgtttgggcagtcatttcagattacaccgatgcagcttgtgaccacggtttcttctattatcaatggagggcaccgtatcacaccgcattttggagtaaagatcaccggggaaggaggaaaagaagtggaaacgctgcggtatgagacaaaaaatgatatctgcacaaaagaaacatcggaaacgatgcgatatcttttggagagggttgtctccgatggcagtggaaaaaatgcaaaaatcgaagggttttccatcggtggaaaaactgctacgtcacagacacttccgagaagtgaccataaatatatctcgtcgtttctcgggtttgccccggcggatgatccgaaagtactggtgcttgttgtgatcaacgatccgaaaggaacttattatggtggtcagatcgcggcacctgttgccaaagaaattatggaaaacattttaccgtatcttgcgaaatgatgaaaaatgacgtatactattgtgttgttaaaaaagtacatgaggtgtgaataatatgacatatgaaattgtaataccagtaatcatcgcatttgcgatcagtgcactgttaggccctgtagtgattccgtttctgagaaaactaaaggtaggccagacagaacgaaaagaacttgaatctcatttaaagaaaaatggaacaccgacgatggggggaattatgattcttgcaagtatcatcataacatccctgttttatgtaaaagattatccgaagattattccgatcctctttatgacagtcggatttggtgtgatcggatttttggatgattatttaaaagtagtattgcgccgctctgatggactgcttgcgtggcagaagatgattcttcagatcattgtcacaggtgtatttgctgtatatatggtcaaatattccggtgtggcgcttaccatgctgattccgttctccggaggaaagtatttagaccttggatggctggcaatcccggtcctcttttttgcagtggtcggcactgtaaacggaacaaactttaccgacggactggatggattggcatcgagtgttacgatcatggttgcgacttttttttccgttgtagcgatcggaacaaatgcagggattgcgccgatcacctgtgcggttgtgggtgcactgcttggatttttactgtttaatgtatatccggcaagcgtttttatgggagataccggatctctggcactgggtggctttgtagtgtcgacagcatatatgatgcagatgccgctttttatactgatcgttggactgatttacctcgtggaggttctgtctgttatcattcaggtcacttattttaagaaaacaggcggaaaacgtattttccgtatggctccgatccatcaccattttgaacttggcggatggtcagagacaagggtcgttgcggtattttcaatcacgacagcaatcttatgcctgattgctttactggcgatgtaaaagacggcatgcagtctgtggctgcaggtttacccgtggatagaagtctatgactgaaaacaatagaatgcacgctccgcgaacattctattgtcatgaattagatatatggaatggagtaatgcatggatctgacaggaaaacgggtattggtggcaggacttggaaaaagcgggattgctgccggagcgttactaaagaaaatgggctgtatggtctgcctgtttgacggaaatgaaaaattcgaccgcagtgcatgggaaaaaacatatcctgtattttcggattgcccgttgtggattggagaactgccggatgcggcagtacaggagatggaacttgcagtggtaagtcccggaataccgcttgatacgccggtgatattaaaattacaggctgcgggagtgccggtcgtaggagaggcggaacttgcgtaccggtttgaaaaagggcgcgttgcagcgatcacgggtacaaatggtaagacaacaacgacgacactggtgggagaaatcttaaaaaaatgttatccggaagtctttgtggctggaaatattggtattccttatacttcaattgtggagaaaactacagagcagaccgtcacagtgacagagatcagcagtttccagttagaaacgatggaaacatttcatccgtctgtttctgcaattttaaatattacgccggatcatcttgacagacatcacacgatggaggcgtatatccgtgcaaaggagagcattacaaagtgtcagacaaaggaagatacctgtgtgctcaactatgaggatgaaatacttcggaaatttgccgaaacattaaaagtaaacgttttgtttttcagcagtaaaagaccattggaagagggaatttatctgcaggaaaatacgatctggatcgctggaaaagaaacagaacggcagcgcctgattgatgtcggtgaattaaaacttctgggcatacataattatgaaaatgttatggcggcttccggcactgcactttgtatgggagcaccgatagatgttgtgcagcgtgtactaaaagagttttggggtgtaaaacaccgcattgagtttgtgagagatctgcagggtgttttgtactataacgattctaaggcgacaaatccggatgcggcaatccgcgggatcggttcaatgaatcgtaagacactgctgatcggcggcggttatgataaaaatcttgaatttgatgcatggattgagagctttgatgggaaagtaaaatgtctattactgatcggacagacaaaagataagatcgcagtctgcgcaaggaaacatggttttgagaatattgtatgctgtgatacattaaatgaagcggtaaatatctgttataggctggcaaagcccggggaagcagtattgctttcaccggcatgtgcgagctggggagattttaaggattatacacagcggggagaactgttccggcaatatgtcatggaactgccggaataaaacggttgtggggcttgaccagacaggttttgtgtaaatgaggaaaaattatggcaagaagacggaaaaatgaaaaaagacaaaaatcgatccggtattttgattacagcctgttatttctgattatatttttgttatgtttcggactgattatgttatatagtaccagttcctactatggctcaacaagatttaacgatgcagcatattatgtaaaaagacaaatgtatgcaagtgcacttggaatagtggcaatgctttttatttcaagaatcccatataagttctggatgcagctttcaacgcttgcgtattttgtggcgctggtactttgtacagcggtcatttttgtcggaacaagtgcaaagggacagtcgagatggctcaggatcggaccgatccagttccagccatctgagatcgcaaaaattgcggttatcattttccttgcgacgatcatctataaaacgcctaaacgcattggggaaattatgagtctgcttaagatcatgcttttgatttcaccggttttggcagtggttgcgtataataacttaagtacggcgatcattatccttggaattgctgtctgtatgttatttgttgcgagtccgaaatatttacagtttattttaatgggaataggagtatgcctttttggtgctctgtttattctgctggcgtcttaccgtgcggaacgtgttatgatctggctgcaccctgaggattatgaaaaagggtatcagacgctgcagggattatatgcgatcggttcgggaggccttttcggaaaagggttaggagagagcatgcagaaactgggatttatcccggaggcacaaaatgatatgatcttttcggttatctgtgaagaacttggactttttggtgcagtctgtctgatacttttgtatctgcttattatctggcgtctgatgatcattgcaaacaatgcatccgatctgtatggcgcattgatcgtagttggtattatggcacatttgtccattcaggtactgcttaatattgcggttgtaacaaatacaataccgaatacgggagtatcactgccgtttatcagttatggaggaacatccatatcgattttgctggctgagatggggctggcactttctgtatcgaggggaattaaattagaggttgcctgattatgaggatcaaagaacagagaaaaagaaaaaaaagaagaagaatcgggatctgtatctttctggtagttctgatgttgtttgcacttgcggcacttattgtggtaaaggtatttacagtccagaatgtagttgtggaaggaaacagtctttattctgccgaccagatcaaaaatatggtgctggacgatgattattcgtggaacagtctgtatgtagatctgaaataccggtttgtggatgtcggggaagtaccgtttgtggatacgatggaaatttcgctggatgatccgcatacattgcggatttcggttacagaaaaaggtattctgggcagtttttatattgatacgcttggacaatatgcgtactttgataaagacggatttgttgtggaaacttcgtcggatgtaatcgaaggagtgccaaagatcacgggagttacctgtgatagtgtggttttatacgaaaaactgccgcttgaggatacaaaactgctgagaaatctgttgacactgacacaactactgaaaaaatatgaacttgaaccggaagaaatccactatgacagtgcaatgcagccacagctcacttacggaacgattgcggtcaatgttggttcagaagattatctgacacagaaaattgcgagactttccgcaattatgccacagttgtcgggactctccggtatactgcatttagagacatggacgccggatacgacagatattgtgtttgaccgtgcagatttgtaaaaaaaaagtgtaatcttttttgaaaaatcagttgattaattgtaagaaaaattatattatagattatatgagttttttagctgtaattttttaagctaaatgaaggaggaactaccttgctggagattaagacaacagaagcggataccagtgcaaagatcatcgtgatcggagtaggaggagctggtaataatgctgtaaatagaatgattgatgagagtatcgggggagtcgagtttatcggagtaaatacagataaacaggcgttggcactctgtaaagcaccgacactgatccagatcggtgaaaagctgacaaaaggacttggagcaggagcacagccggaaatcggtcagaaagccgctgaggaaagcatggaagaattatctgcagcagtgaagggcgcggatatggttttcgtaacctgtggtatgggtggcggaaccggaacaggtgcagcaccggttgttgcaaagattgcaaaagagcagggaatcttaacggtcggcgttgtgacaaaaccattcaaatttgaagcaaaacagcgtatgttaaatgcactttccggtattgaccgtttaaaagagagcgttgatacactgatcgtgatcccgaatgataagcttctggagatcgttgacagacgtacgaccatgccggatgccttaaagaaggcagatgaagtgttacagcaggctgttcagggaattacagaccttatcaatctgccggcactgatcaatcttgactttgctgatgtttccactgtcatgaaggacaagggtatggcacatatcggtatcggtaatgccaagggagatgacaaagcaatcgaagctgtcaaacttgcagttgcgagtccgctgttagagaccacgatcaatggtgcatcccatgttattatcaatatttccggtgatatttccctgatggatgcgaacgatgcagcaagctatgttcaggatcttgcaggtgataatgcaaacattatttttggtgcgaagtatgatgagtctatgacagatgaagctacgatcacagttatcgcaacaggacttgagaatgcggcagcaccaaagagcaagattatgccggatctccgctatggaaatacaacaaacgttacaagaccggttggaacacctggcatcaacagacaggcggcaaatcttggcgcaagtgtacaggcacatacgcagacacagacggctgcaccatcattttctggtattcagagaccgcgtcagcctgagagcacagtacagccaatggatattaaaattccggatttccttaaaaattcaagaaaataatatctgagataaaatattagaaaacataacaacagatatgcctgcaaagtacgcgggctgctgtagcagtttatacatctgaaaagagatttatgtgtttgaagagaaaacacataaatctctttttatatatagaaaagaacaacgcttgtcgaaaataagggatgatttgcgggatttggagtacctgttttgacaaaaagtaaagttgtactgttttataataacagtaaagatacgaaagagtctggagaaaaggggtgagacgagatctatgtattttatgcagatgtgttcctgcttgaaaatctgtttatggactatatggcaatacttggatgcaactgcctgctgaaacggaggatacatcccgggcggctgtttgcggtatcgctgatgttttcactgattcatctgtttctggtgtgctttatccataacaggatcctgtattttttgatcgcacattttgttttaaacacagggatggtatttttttgttttggctgggaaggaaaacgcagttatttagaaaactgggttgtgacctattttatgtgcgtgatacagggaggtgcgcttgagtggctcttagaacagcatatattttcgcaaaatgaaattttacagatgcttgttgtggcagcggtagttgttacggcagtgatctgttttggtgaaaggcgcgtttgtggaaatcatatttatcctgcagagttaaaaaaaggagaaaggcatatcagactgcgtgcatactgggatagcgggaatcagctgacggatccgtacacaggacaggagatcagtattctatcaggatctgtggcggaaaaattctttacaaaagaaaaggatctggttcgttttgtgccatatcgatcactgggggaaaaggatggactgatcgcggtaacaaatgtggatgaaatgactgtttttcagggaaaacgtgcggtaaaaatcccacatgcagcgattggaaccgcagataagatgctgtttgacggtaaggaatatgaaatgctcttaaatgcttcgagcattatgccacaaggcggcaagacagaaaataagaattaaggtggaattgaaaatgtacataaaatttgcgataccaaagataagaacgatgatatttcccggtatttttcgaaagaaaaaggatgaggtgcattatatcggaggcgcagaggtacttccgccgccgcttgccggtgaagatgaggcggtatgcatagagatgcttaccagtgatgaaagcggacagattgcaagaaaacggctgattgaacataacttgcggcttgtggtgtatattgcaaaaaaatttgataataccggcgtcggggtggaggatctgatttctatcggtacgatcggtctgatcaaagcaatcaacacatttaattccgggaaaaatatcaaacttgcgacctacgcttcgagatgcattgaaaatgaaattctgatgtatctgcggcgaaacagcaaaacgagaatggaagtgtctattgatgaacctttaaacgtggactgggacggaaatgagctgttgctttcggatatcttaggaaccgatgaggacgtgatctatcacgacattgaaacggatgtggaacatcggctgcttaagacagcgattggaaaactatctggcagggaacggatgatcattgaactgcggtttgggttaaattccatcgatggagaggaaaaaacccagaaagaggttgcggatatgcttggtatttcccagtcctacatatccagactggaaaaaaagatcatgggaagactgaaaaaagaaatcgtgcgtcttgagtaaagtctctctgtttttgtctggtaaaacgacaaaatagttaaaaaacatataaaatatgaaaaaatattgtgcatatagctgaaaaatagtataatgaaagaaaagcagacagaatgggggacttcatatggtattggaatttttaggcgcagcacatgaggtaacaggcagttgtcattatctatcctttggagataagcatatactggtggactgtggtatggaacaggggccggatctgtacacaaatcaggagattccggtcaatgcagcgatgatcgattatgtatttgtgacgcatgcacatattgatcattccggattattgccgcttttatacaatcatggtttccgcggcaaaatatactgtaccttagcgaccaatgaactctgcaacattatgctcaaagacagtgcacatatccagatgttcgaggcagaatggcgcaatcgtaaggcaaaacgggccggaaaaccggaagtggtgcctctttatgatatgaatgatgcgatgagtgtactgagccattttgtgccgtgtgattatcagaaaaagatcaaagtctgtgacggacttgagatccgttttgtagatgcaggtcatctgcttggatcctcaagcattgaaatgtgggtgagggatgatgatggtacagaggtaaaactggcattttccggtgatatcggaccaggtaaccgtccgctcatcaaagatccggaatacatcaaagatgccgattatgtgatcatggagtcaacctatggtgacagaaaacacaatacacctccggatttcgcgatcgccctggcaaaagtgatcaaagaaacattgtatgaacgcggcggtaatctggtcgttcctgcattttccgtgggcagaacacaggagatgctttattttatccgcaggatcaagagtgagcatctgctgccggaatttgaaaattttgaggtatacatagacagtccgttagcggttgaagcgacaagcatttttaacaagagtgtggaagaatgttttgacgaagatgcgagagcacttgtgcagcaggggattaatccgatcggatttccgggacttaaaatggcgatcacaagtgatgagtcaaaaatgatcaactttaatgataatcccaaagttattatctctgcatccggaatgtgtgaggcgggacgtatccgccaccatttgaaacataatctgtggagaaaagattccacgatcttattcgtgggatatcaggtgccgggaacacttggcttttcactcttaaatggtgcaaaagaggtaaggctctttggtgagacaatcgaggttgcggcaagaatcgagaacctgccgggtatcagcggccacgcagatgtggaacaactgacaaaatgggcggcagcattcgaaaataagccgaaaaaagtatttgtggtacacggggaagacaaagttacggagcagttcgcggatcatttgaaagatactttggggtatgaggcctatgcgccgttcccgggagatgcatttgaccttgcaaccggcgaacaggtacgcgaaggatccagagaacgggcagagaagaagataacagagaagagccgtgcatcgagcaatgtatttgcaagactgcttgctgcaggccagagacttctcacggttatcaataagtgtgagggaatgccaaacaaagaacttggcaaatttgcagatcagatcaatgctctgtgcaataaatgggatcgttagagcgacagataatgacgaatggattttaatgcagatttttctaagcggctgacctgagcctgggagatatggatctcgtcagccacttccatctgcgtttttccttcaaaaaagcgaagctttaagatataattttcgcgttcgtttaaccggtcgagagcatcgtttagggacagctcttcaacccagttttcttcccggtttttcttgtcactgatctggtccatgacatagagtgtgtcaccgccatcggtgtagaccgggtcataaagactgagaggactctggatggcatcgagggcgaaaacgatgtcctctttagaaatgccggattcggcggcaatttcgtcgagagtcggctctttgttttccgtctttgagagtatttctttggtgtggattgccttgtaggcagtgtcgcgcagggaacggctgacgcggatagagttattgtcgcgcaggtaacgtcttatctcacctatgatcatgggaactgcgtaagtggaaaacttaaccccgatcgtcggatcgaagttgtcgatggacttgatcaggccgatacagccgatctgaaacagatcatctacattttcgtgattgccggaaaaacgtttgatgacacttaataccagcctgagattgcctttgatataagtttctctggcagcggtatctccctgtttgatccgtgcaaacagagcatctttttcctcttctttcaaaatggggagttttgcggtgttgacgccgcagatttctactttataagaagccatgctgtttatcctccggaattttatctttaccataaagagcatgcttcaaaaggatgaattttattcagaaattaactttttttccaatgggtttcgtgctaaaataaaaaggtatcaaaaatcagaacagagtgtggtgcagtgatgatgaaagacatgatcgataagagaaatgaacgggaacgtatcgcaagaagtattatcaagtactggaatgtgaactatattccgagaacgcaggctgattccgggatgcagaagcagactgcggaggcagaaaatgcgcaagaccagactatggatccaaatatgcaggaagactacaataaagcaacgaacgcatattcgggtaaatatggtcaggagaaagacttagacgaagtgacgaaagatcagattgacaagatcctccatgagaaggcggaacatattcaccagttgtttgaaaatgggggagtagagtaaccatttcctgttattctgcatatgatatcacaaggaaaatggcagaggaatcaagatgtctgagatcatacttcgcaaataccatggagttggcaatgattatctgatctttgatccgaagaaaaatgatgtagttttaaatgagagattgataaggcagctttgtagacgcaatattggtgtcggtgcagatggaattttgtacggaccggttatggaagataaaaaaattaaagtacgaatttttaatccggatggaagtgaagctgaaaaaagcggcaatggcatccggattttttcaagatatttaaaagatgccggatatgtaaaagaaaggcaatattatctgaccacgaaagcgggggaaacactggtaacatttttggatgatgctggaagctgtatgcgtgtggatatgggatatgcggtctttgaggcagaacagatcccggcacttggatttgagggagaagttgtgggagaatcgatatttttctgcgacaatttttataatgcgacctgtgtatccatgggaaatccaaattgtgttattatgcttgagagggtagatcgtgagaaagcactgcatttagggccatatgtggaaaatgcaaaatattttccaaaccgtatcaatatgcagctttgtcagatcgtagatgaaaaaaatatacaggttgaaatttatgaacgcggggcggggtatacatttgcttccggcaccggagcctgtgcggcagcagcggcttctcaccgtctgggattagtcgaagatgcagtgactgtacatatgcacggtggagatctttttatcgaatttgaaaaggatggaagaattttcatgacaggatcggtcgtatatataggaaagattactgtggcagaacagttttttgcctgacagaaaacgaaagtggcgaaaagaggggaaataagttacaatgaaagaacggtatcaattacgccaggcagcgggggcatactggcttttggatatggagcagggggaacaatataaaaaaccattcatgttgaacgagtgcggtgcatatatatatcgtgcgtatatttcaggaatgtctgaggatgagatcatgcaggcatttgcaaaagaatatggattgtcattctcctgcgcacaaagcgacgtagggcagtttatgatggagttaagacaacagggaattatttgagaatggagcaggtatgaatatattgctagttgggaatgccggcaattttatgcggcttatgatcaacagactgaataaggaaggacacagggtctttgtgctgacagaagaaccaaagaagggatacagcctgaagaaagtatttgaagtgtatcatttttcgtatgaggatgcctgtgtgcgggaggtattagagagtattatgccacaggtagtagtttttctgggggcatatgaccataatttttcctggaacagggtggaaaacacagcggcgtcctatgcagcgggacttacgaatatactgatgaattataccgctttaaggaaaggcaggtttgtctatctttcttcggagagtgtttttggcggtggaagcgcacagtttatgacagaggatgatcctaccggggcatacagcaagaaaggccaggcgatcgctatcggagaagatatctgtaaaaattatgcaaggatggggaatgatgttgtgattctccgcctcgatcatttgtatggggaaatacgaaagaaagaggatacagatacgatctgtgcggatatgtgcctcgaagcagtccagaccggagagatcattgcgtcgcagaatgaaaaaataatgcttctgcatgaggcggatgcggtggagtttatctaccagataatggtggcaaaagaccataaacataccctctatcagttatcttccggggagaaaatgtcacggtatgagcttgcccaggctgttgccgcaggaatggagaatgaggtcagtatcgtagaagaggaaaacaaaaaataccgggaagttatgctttccggtaaaagatacgatgaagaatttggaagccgtgtgcttcatcatgcagaaacagatgtggaaaagattgcggcttatttcagcagacatgtatctgaatttacagatgcagggcagaaaaagggatatctgtttcgaagattaggcagcaggacaaaagaaatcataacgaatctgattccttttatggaaaacctgatttgttttattccgtttttcatgttgaataaccgtgcagtcggaagtgaatactttcagaatattgatttttatcttctgtatgtgctgttgtttgcacttgtatacgggcagcagcaggcaacattttctgcattgcttgccgtggcagggtactgtttccggcagatgtaccacagaagcggatttgatgttatgcttgactataatacctatgtctggatcgcacagcttttgatcttaggtctggcagtgggatatctgagagaccagcttcgtgcaatgagggaggaacagcggcatgaagtatcatacttaaccaagcagttagatgatatttcggatatcaatgtcagcaatgtcagggtaaaagaaattctcgcaaaccagatcgtaaaccagaatgacagttttggaaaattatatgagatcacatccagtttagagcagtatgaaccctgtgaggtacttttttatgcggcggaagtacttgcaaaactgatgggaagcaaagatgtggcaatctatacggtggcaaaccgttcctatgcacgtcttttttctgcaacatcggagaaagcacgcagcctcggtaattcaatcaattacagcgagatggatgccatgtatacggtgcttgccgggaagaaagtttatattaataaaaatatggatgaaagatatccgcttatggcaaatgccatttattcggaagatgagatgcagctgattctgatgatctggggaattccgtgggagcggatgacgttaggacaggcgaatatgctgacggttatcggttatctgattcagaatgcggtggtgcgtgcaaaccgttatatttctgccttagagcagcagcgttacataaaaggaacgaatatattagaaccggaagcctttttagcacttgtaaaggcatatttaaatgcgcgtgataaaggattgacacagtgtgcactgctttccgtggatacaaaggaaaatgaccgtgatgaggtcgggaaaaggcttatcaaactccttagacaaagcgattatgtcggtgaacttgaaggtggaaaaatgtatgcgcttcttgcaaataccagtgcaaaagatgcgaccatggtaagagaaagatttgaaaaagagggtgtgtcctgccagatacaggaggatgtatttgtatgacggttgtggaaaagagattttgtatcgttcttctgatcaatacggctgttgctgttttatatgtgataggaaacagcaggatcaggcagaaagaaaaaaatacagatattctgatgaaggggatcgtgatgtttctctgcccggtagtgggaccgttgttttttttggcgggactggtgtttaacaaggtttttttccggcagaacgtggatcttgaggatgttattttcagcaaggagcgtgtaaagacacatcttcgggcagatgaggaaagggaaggaaatttagtaccgattgaggaggcacttgcgatcagcgacaaagacagtttaagaacgctggtcatgaatgtggtccgtggggatgtacagaattctctggcatccatctcgcttgcgttaaacagtgaggacacggaaacatcacattatgccgctacagtattaagggatgcattgaatgatttcagaaagcgtgcacaggaactttaccttcagatgaaacaggagggagttgatgcggcagaagcagcctgtatcctgattgagtatatgcatggggtattgatccaggaggtgtttcatgaaaaggaacagcagacctacatcgatatgatggaggaggcatgtaattttctggatgaaaaataccaggagaaactgcaggcttcctatattgagggactttgcgttctgcttcttaagataaaggattttaagcgcatgaaatactggtgcgataagagcagggaactctatccggcagaattatctacctatacctgttatttaaaactttattttacagagggaaacaaaaaacatttttttgatgaattggaaaaattaaaaaattcagatattgtgatcgacagggaaacattggaattaattcgtatttttagctaaaggaggtgatggcagtgtcgatgaaagtcctgactgtgttacagtttatcagcattttcacaatttatacgggactttttatcgcagttccggcactgcttctgcaccgcaggttaaaagatgaaatatttagtgtacggtttttcttttatatcgtattaggtcatttctatctgatcaatctggtattatttcttcagctgcttcatatttcaggcagatttacgctgattttgggcagtgcacttccagtcgttatatccttggtacatacgaaaagagtttcacctaaaaaaatcggacatatcataggaaacagaacatcccatgtgatccgggagacgcttggcattaaattacttcttctggagattgtacagtggattggcagaaaaattaagaaactgtgtggcagaatgtgtgggctgatcatcaggcattttgcagatggagtgctgtttgttgtatttactgcaacggttctggtaatgtatggaaccaatatgataaatacatacggttattgtgcatccgatataccggtacacaattactggatcaatgcgatggggcagaatgatgtgtttgtagctggaatttatccatttggattccactgcgtaatttattatatccatacggtaacagggattgaaacgtatgtgctgctccggcttttttatgtggtgcaggtcttatatatccattatgcacttctggcatttttgaaagcgtgctgcaggacatcgtattgcgcatggggagctgtatttgtctatgtacttgctgcattttttaacaggaatacttactcgcgttattacagttcgctgcctcaggaatttggcatgatatttatcctgcccggcatttattttatgtatgcctttttaaaacagcggaagatagaagtgaatcaatgcaacaaggaaagaaatgctgccggattaaaaacctggaaatgcaaaagtacccgttatcttatgggatttattgcaggatttggacttacgctgatcgtacatttttatgatactatggtagcagggttgttttgtatcggtattgcaggaggatacctgttgcgtattttcaaaaaggagtattttttcagggttcttgcgactggtcttttaagtatcttcttggcagtgcttccgatgggaattgcctttttacagggtacgcctttacagggatcgctgggctggggactcaatgtaattaatggcagcaataatacgggtgctgaggaggaagatgaagcagatatccctggcagtgaaaaggaagaaataaatacaaatacacagagtgtgacggatcagagcatgacggaaagtacggatactgccgggagcataacggatcagacaatgtcagaaaatggtgtggaaaatgcacagatgacagaagggacgcaggtaaaaacaacaaggtttggtatgctggtggaaaagatacgtttccggattacggatattacccaaaacggattggattatctgtggacaggagtgcacaatgttgtaatgcttcaggcaagcgtgccatggatgttgtttatttttgggtgcgagggattctgcctgatcggtggactattgtttacgctcattggaaaacatgattatggatcaatgctgatgtccgcaggatttggtctgctgcttttgatgatgtttctttctgcatggcgttttggactgccacatatcatggatgcaagccggtgcagtatctacgtcgcttatatgataccggtagcgataggacttggaatggacggtatggtaacattggtctttggattttttaagcggaatatctggatgaatcttgtttcactgatgacgtcagcggcacttgttgcgacacttgtcaatggaaatcagatccgtacaccgtcaatattgacggcactgcagtcgaatgcggcgattacctgtctggcaaatataaagcgggagaacgaaaagtataaatatacaatctgttctgcgaatgatgaactgcgaatgatggaagattatgcacgtcatgaggaaacaattacatttttacggagtatggaaggagatgcggtcaatggaaatctgacgctgccgacagaccgcgtatatttctttattgagaagataccacttgattataccgtggcatatgagggaagcggacagctcatttcagaagaaggagcaaaaaaaccgctgccaacagcaggagatatttcggtttatgaaggtgaaaaccgatggatcgtaatgtcaagaatgtattactgggcacaggcatttatggaactgtatggaaaagaaatgcaggtgtattatgaaacagatgattttatctgctatgtggtagaacagaatacctacagtttatatgatttttcaatcgattatggatataattgacggaaaaataatggctgcaggatgagatggatttggaaaggaaaatgtgatggtatcccgaagaaattttgctgcaatcacgatcatgttaatgattttactgtttatgtttcaatttacgggtgtgatgaaggataaattaagtaaatatgggatcaatgaatacaaggaaagtgccacaacggaactgacaaaacaggatatgtatctggcatccgggcagaatatacagaaaacagcaggtgtgctgtatattggaaacagtgaggcagtaaagaataccgtaaaatggtggtgtacatatagcaaacgtgaatttcagacagcggactcttttgatggtatcgtgtcggaagacagcaggctgccggatatttgggttttagatggaacctgtctgaataccagggataatataaaggcggtcagtgatgcagccgaaaagggagtaaatgttatagtttcaggactgccggatgcagaggaaattgagaagaacgaccgtttgagaaagctgcttggaatccgatatgtggaacagaatgaagtgacacttgacggcatacacttatttgaaggatttctgctcggcggggaagtgatctatcaggcaaaagatgaggaagaagagaaaaatcaggatatggatcttaaaattccatggtatgtgacgggggagggcacaaaaagttatatggtcggaatactctcagatgttcggccggacagcggaagacagcctgccattatatggagaaacggactggaaaatgcctgtgtgttttgcattaatggaaattatttaaaggataattccggtattggcattctggatgcaatgatggcagaatcgtattcgtttgagatttatccggtgatcaatgcacagaatcttgtgattgcaaattatcctggatttgcgtcggaaaatgaagataaaatggaaaaaatatacagtcagtcacaaaaggcattatttcgagaaatcatctggccgtcgctggtcgcaattgaacgaaagatcgatgcaaaactgacctgtatgatgacaccgcagtttgattatggagatgaaaatgagccacgggagggagaagtggcatattatctgaaattattgaaagaagaatacggggaggcaggactttcatccggcaatgtatctggaaccgggttgtcggaaaaaatggagaaagacgaaacgttttggaaaaaagaggcaccagattattgttttcagtcattatacctgcaaaatgaagacgaactgggggatgctttggaatgcgaggaacttgatggaataaggacgattgtaaccagggaatcacagaccagcgacgaaccgatcgtttcctttgcaggggaagaggtgacactgcagcgtgctaccggagatggtgtgaatcatacatttatggatgatttcagacagagatgtatccagaccgcattggggtattcgaatacggtatgggatctgcttgcagcagcatatccggagaaaaaggatgatgcgtgggagatcctttcgaaggaagcagcgtctaatatctgtacttatcagaaaccgtttacggcatttgatgagacaacgatctcaaagagcgatcagaggataaggagatttctggcactttcttattcagcagaatctgaagataatatgatttccctgcatgttgacggattagaagaggaagcatggtttttactgcatacgggaacacgcgaagcagaggatatacagggaggaagtttttctgtagtggaggatggtgtttacctgatctgtgcagaagaggatgaggtaaaaatccggttgagtgaggaagaagaaaagcaattgttttattacgaggattgaaaatgaaagtatgtattgtagcagagggatgttatccttatgtggtgggcggcgtttccagttggatcaacagtatgataaaagcttttcccgacatagaattcgtggtgcttgcgattgtggcaaaccgttcatacagaggaaaatttgtttatgaactgccggaaaatgtgtcggaagtttatgagctttatctggaagattatgactgggtagagcaggaaaaaaataaaaaactgcatctgcgtcagaatgaatatgaggcactgcggtcattacttttaaaccgggatgttgagtgggatacgttgtttacgttgtttgaaaagaaaaatttttcattgaacgcgcttttgatgggagaagattttttaaatgctgtgcgggaatgttatcagctcagatatccacaggttgttttttctgatttcctctggaccatgcgttccatttatctgccactgtttctgaccttgaaaatggaactgcccgaggcggatctttatcactgtgttgcgaccggatatgcgggagtgatcggaagcatggcaaaaaaaagatatggatgcggactaatggtttcggagcatggaatttataccagggagcgggaggaggagctgatccgtgcaaagtgggtaggcggtatctataaaaatatctggatcgaacagtttaaaaaaatgtccctgctcgcataccggtatgcagatcaggtaacctgtctttacaagcatgccatggaacttcagatcgaactcggatgtccggcagaaaaaataaagatcacaccgaacggtattgatgatcagagatttgtcagatgccttgaagaagagagaaaagaagatgacaccatcaatatcggagcggtgttaagaattgcgccgatcaaggatgtcaaaacgatgataagagcctttgcttatgccaagaaagaggcaccaaaactcgcattgtggatcatgggaccatccgatgaggaaaaagaatatgccaaagaatgttttgaactggtggatcttcttggcgtggaggatgtgatctttaccggaaaagtcgatgtgacagaatatcttgggaagatggatatgaccatactcacaagcatcagtgagggacagccactgacgatcttagagagttttgcggcaaaaaaaccggtgattgcaacggatgtaggcaactgcagggggctgatctacggggaaggcgattcatttggggaagcagggatcattacacatatcatgaatgtggaggagattgcggcagcgatggtagatctggcatgccacagagaaaagaggattggcatgggaaaaaacggataccggagactaaagagccggtatcttgtggaggatatgaaagaaacataccggcagatttaccggcaatttggggatgaaggcagagtgcagggaaagaaaggggatgtgtgatctatggcaggaataggcgtaaaacttcagaaaatttatgacaggcgcacgatccttgcaaatctggcaggattcggttacagtaccatggtcacgatcgcccccatgtttgtcgtgatcggaaatgtgatgttaatgagccattttcttggatacgagacagtagggtatgcgagaagaggattattttcaggcacggtactttatatttttatattttccctgctggttgcggcaccgtttaatgctgtattatcgagatatatgtccgatattatttatgaggaaaagtacgaagatatcctgccatgttatgatgtcggattatttttaaatatttgtttcgggtgtctgtttgcaatcccgttctgtatcagggagtatctgaaggggcaggtggatctggtgtttgtgtttaccgggttttgcggctttatatcgcttcttctggtattttattccatgctgtatctgtcgatctgcaaggactatcagaaaatatcattatttttcctgatgggtatggcagcggcatttgggcttgcgtggctgctcgtgaaagtgtttcacagggacatcatatacagcatgcttctttcacttacgatcggatttttcctgacggcggcgatatcagcggcaacgattaagagttattttaaaaggaacagccgccagtaccgcaaggtgcttcattatttcaaaatttactggcaccttattgcgacaaacctattgtatacgttaggattgtatatacataattttatattctggacgacggacttaaagatgacggtggcacatacgtttgtctatgcgcctgcatatgatatggcgacctgtctggcaatgtttacgaatctttcgtcgaccatcatttttatcagccgcgtggaaatgcattttcatgagaggtacaaggcatattcggaggctgttatcggtggcagatgggaagatatcaataatgcaaaaaacagaatgttccgccagcttgcatctgaacttatgaatcttgtgagaatccagtttattgtctcggtcgtgctttatctgctctgtgtgatatttttgccgggaatgggcttttcaggacttgtgatgcagatttatccgtgtcttgcagccggttactttattctttttttgctgtatgcggaactgatttttctgtattattttaatgatatgacaggagcacttttaacggcggtctgcttttgtctgggtacgttttttggaacgctgttttcaaaacagcttcctgatatctggtatggtgcaggacttgtcatgggaagtttctttggctttaccgtcggatatttcaggcttcgctgggtggaacgccatatggatgtacatattttctgccagggtgaattgtttaagataaagcggggaagaaaaccttccgcaaaaagttatgacagaaaagaggggataaaagcatgatattgaaaatgatgttgattgtttttggaatttttctgctcattttggatctttttatgtatgcaaggcagaaactgacggatgggatcggacttggctgggcgattgtttctgcgacatttcttgtatctggcattgcggtaagtacggatgcagccacatacctgtggaatggagcaaaaagtgtggtactgtttgcatttgctgtgtttgttgttataatcctgtttttatttaaaatcagtatggcagtgtctgttgtggtggtaaaaaaccaggaactggcgatgcaggtatcactgctcaatcaggaaaatgaaagaatattgcaggaactgaaagggcttgtggatgaaaaagaaaatattgttcgtgattaatacattaggcggagccggtgcggagatggcacttttagaactgcttgaaaaactggaaaaggaaaatgaaaagacaaaagatgtgcagtatgagatctctctttatgttctgatggggcagggggaactggtgaaaaaactgcccaaagaggtcctgctgaaaaataaatcttatcagcctctgtcggttttgcagaaagagggaagacattttatgtataggacgattttaaagaccatgttcgtccggggtaccgtattctgtctgctgccatatcttttgtcatcacttgcggatatgttaaaacggcggaaggtgctgccggataagctgctctggcgtgtgctctccgatggaggagaacgttttgcggaagaatatgatcttgcagttgcctatttagagggtggatctgcatattacgttgcagatcatgtccgtgcaaagaaaaaggcggcattcatacatattgattacacaaaggcaggctataccagaaagttagaccgtgactgctatctgaaatacgacgccattttcccaatcggggaggatgtaaagcagcagtttttaaaagtctacccggaatgtgccggccggacaaaggtttttcataatattatcgatacagagaaaataaaaacaaaagcatcgctgcccggcggattttctgatgattttgatggcatcaggcttcttacagtcggccggctgacggaacagaaatcttacccgacagcaatcagggcgatgaaaaaaatcaaggagaaacataaaaatgtccgctggtatgttctcggagaaggaccggaacgaaagagactcgaacatctgatcgattctttgggattacaggaggattttattctgtcaggttctgtggaaaatccgtatccgtattacaaaagtgcagatatctatgtacatgcgaccggatttgaaggaaaaagtattgcaatacaggaagcgcagacgcttggacttccaatcattgcatcggagagtaaccgggaacagatcgaaaatggcgtggatggtattttatgcagattagaaccggaagcggttagtgaagctgtatgcaggatgatggaagatgagaaactgagaaaccggtatcgggaggcatctcttaagaaaaatgttgtctatgagaaagatatggagctgcttaccggtttactgtttcgctgacagaaaaaatacatacagcaaaaaagaggagtgggatggaaatgaaaaagcaaaaagagttattgattattatgcctgcttataatgaggaaaagaatattgaagcggtgctttatgagctggaaaagccggaaatttcatccattgcggatattcttgttatgaacgatgcatcttctgattcaacaaactgggtggtgaaggcacatggccatacattagttacgcatgtgtttaaccttggttatggcagtgcactgcagcttggatataaatatgcaatacgaagaaaatacaaatatgtgatacagatggatgcggatgggcagcatgatgtctgcaatattccaaagatttatgagagactccggcagaaggatgcagatggaagatatccggatatcgtgcttggatcgaggtttatggaggggagttctgattttccggtttccgtgaccaaaaaactggcatatgcgctgttccgccagatgatcaaaatgacgacgggacgtcatatctgtgatccgacgacaggactccagggacttagccggaaggcatttttgtactattctaaatataagcattttgatgataagtatccggatgcaaatatgatcattcagatgctgctgcttggatttaaagtggaagagataccggcagtcatgcacaacaggcagacgggagtcagtatgcattccggactgaaaccggttatttatatgtttcgcatggtgttttcgattatcggagtggtattccgtgtaaaagtattaaaaattgatgcgggggcggggaacgaagatgtttttctggaagaacagaaataaaaaacattttacagtcagatttccggaggagagcagggaagtatgtacaaatccgggcagaggatggtaccatatttatacatttacactggataaaagagagaaagatggacttttatatcagccttactgggatgatgaaacattagtgctggtacggtttgatatcggggcatttcgtggaatgagcctttcagaagaggcactggaatatgcagatgaaattttaaaatgttttcacagccggggaaaagaaatcattctgcgcgttttgtatgatacacaggggaaaggaatggaacgggaaccgacattgttctccattgttttaactcatatgaggcagcttggagctgttgtgcgtgcatatgagagcgatatccttatcacgcaggggttatttatcggtaactggggagaaatgcatggatcaaagtttttagatcaggaatacatccggaaactctatgctgcatggaggaaggcaattggacccgacatcagaatcgcactcagaaaaccgtctttttgccgtatggcagtgacaaatgagaatgacaaagcagtaccaggggtatttgatgatgcgatttttggctcagaaaatcacatgggaacttttggagtgaaacgtcgtgcggacagtgcatggacagaggactggtgcattgcagatgaaatcggttatatgcaggaaacctgtggtcagatcccgtttggaggcgaggtgctttccggtcagaatcctgctgcaaaggaaatgctgcgggcattgtgtgatttgcgggtttcatatttgaacagtatccatgaagagcaggttctgaaccggtggaagcagatggaatatggggaatggggcagtttctaccagtatatcggtgcacatctggggtatcgttttgtggcagggagtgcagtattttatacggacaggattgaggtggagatagccaatacaggattttcaaatatctgtgataaaacagaacttgcacttgtaagagagaatgaggatggaacggaagaagtgtatcaggcagattatgatcttcggatgctggcaggacaggagacggtaaaaatcgtatttctgctgtcaggactgcaggatgagaagaaggacagatattttctgaaactgacaagatgcagaggaaacgtggcaatccgttttgcaaatgaagggggagaagaacggttgtatctcagataaaaagggagcatggaaaaacatgacgaaagaaacagataagatcagtgtgatcgtgccggtatataatgtgaaaaactatttagaagactgcgtgcaaagtattacacaccagacgtatccggatctggagatccttctgatcgatgatggttccgatgatggttccggggagatctgtgacagacttcagatgacggatgcacggatcagggtatttcacgaaaaacataagggtgtatccggtgcaagaaataaaggactgaaagaggcggctggcgcatatatcgcatttgttgattcggatgatgtattagaaccggatatgtatacctatctgatccggcttttaaaaacacatgaagcacagattgctgcatgctccggttggtataaatatgatgccggtgtggggaaaaaatttgaaagtccggcagatgtggtctgcatgaacggaagagaagcgcttggtgttttgcatgagagaagctacctgcgtgcctatgtctggaacaaattgtttcagcgggaggtccttgacggaattcgtttttcaacggaattgtcgtttgcggaagattacgagatgttctgccgggtattagaacagtgtgacacgattgtgtgcggaacaaaaacggagtattactatatgcagagaaaatccggcatatgtaatcgtggatacgacgggatataccagaaggcaatgatgatgtttgaggattactgcaatgtgtattcccgcagatatccccaatataaaaaattatttgagaaccattatctgtttgacctgatggggatggctgccgcaatgagccggaatggcaattatgttgctgcagactgcagaaaaataaaaaaatacgtcaggcagaaactgccacaatatcttacagataaaaaggtttctctttacttaaagggaagtgcctgtgtggtcagtgtcagtgtgagagcgtttggtgcggtctatcggatgctgcactgcgcagaatttgaataatctgatagaaactctgagaaaaatgaaagaaaggtgagaacacatatggagaagagcagaacagaatattcgaccatgaataccgtggttgccatgatctcaaggattgctgcgattctgatggggtttgtgacacgtgtggtatttacacacacactcagtgagagttatgtcggaatcaatggacttttcacggatatcttaaatgtactctcactgacagagcttggtgtggaaacggcgatcagttatgcactctatcgtccaatcgcacagggagatatcagaaaacagcagatcctgatgcggatgtttaggacattttatcgtatcacggcaggctgtgtggtagtgttaggattgtcgatcattcccttttttgatgttctcatgaaaaaccggccggatgttgatcatctgatgctgatttattttttatatctggcaaattcagtcgtttcttatctgctggtatataaacgtaccctgatcgaagtgcatcagttaaactatattgttcttttataccagacggcatttctgatcttacaggatatctgtcagatcgtcattttatttacgacacacaactttatttttttcctgagtatttatattgtatgtacactgctctctaatatctgcatttcccgaaaggcggatcgtatgtatccgtacctgaaagagaaaacgaaagagcagctgccggaggatgaaagaaaagatatattccgcaatataaaagccatgctgatgcataaacttggaaatgtggtggtcaataataccgataatctgctgatttcttcttttgtgggcgtcatcagtgttggcatttattctaattatttccttctgatcggctcagtcagacaggtgttagaccagatttttcagggaatcaccgcaagtgttggtaatctgggagctacagaagatgagggcagggtaaaaagcatttttgagactgctttttttatcggaaactggctttacggggcggcggcgatctgcttgtatgaacttttaaatccgtttgtggagctcgctttcggaaagcagtatctgtttgatatgccggtggtcttaatcttatgtattaacttttatatcaatggaacgagaaaagcggtgctgacattccgggactcgcttggattgttctggtttgaccggtataaagcactggtggaagcggtgttaaaccttgctatttcactgattctggtatggaaatttggaacattcggagtgtttgccggaacatttctctctaccatgctcacctctgtatgggtggaaccatatgtgctgtacagacacagactgcatgcgaaggtggctccgttttttgtccgctatgtgatctatacagcggtaaccggtgtgatctggtatggaacagaccggctttgcttatttgcggatggtggaagggtgatcgtatttttaaagagatttttcatatgtgctgtggtgccgagccttgtgatgcttctttgcttttgccacacaaaagaatttggaattgtaaagagaaaagcacttgctatatggaaaaagaggtggacagatggaagaaaaaaataaagagaaagaacttatattgtgcagtcttttggatgcagcactacatgcagaaccgcatgtagaaaatcaggcagctttaaagcagaaatgggaacgattaaaacaacaggaaacggaatgggaaagtattctttccatagcggatcgtcatcgtgtgctgccgcttttgtatgacgtattggaaaatattctgccagaggacggggcagactggaaaagagtgcaggagagaagtacgcagactgtatggcagtcctaccgtctgctttttataagccggtatgtgacaggtcttttgaaagatgcgggaattgatacgatattattaaagggaagcggcgtagcaggactttatccggtgccggaactgcgcaagtcgggggatgttgatcttttagttgagaacggaaagatggcgcaggaggctggcagatgtctgcaggtgcatggatttgtggcagagagcggacatcaggaaaatcaccatcttacttatatgagcccggaaggaatccgtttagagctgcacagtgcattagtggagccgtttgattcaacggaagtgaacacttttttggaaaaatgtcagaaagatttttttgaaaacagggttactgaaaatgtcatgggagtggattttttcctggcctcgccatcatatcaggcattttatctgttattacatatgctgcagcattttttgcgttccggatttggcttaaaacttctttgcgactgggttgtattctgggaacatggatgtacggcagaggaggaagcaaaatttttaacactggtcagagaatgcggcatcttaaattttgcatgtgtggttatgttattttgtgtcagatatctgggattatcagaaaacaaggtgcagtttctggaaaaggcaggagaagccggggcaatgaaagaggaggcttacctggaagagttttttacagagatcatggaagccgaggaatttggtgaggcagattcaaaacgcatggtagccatgaggggaacaggatggattgattatatcagggagtttcatcatcagatgcacctaagccatccgaaagccgggcagtataaaatactttatcccattctgtgggtaaggacatttttcggttttgtataccgcaaccggaaacttcgtggaatatcaagtattgccatcttaaaaaatgcaaagaaacgaagccggctggtaacgaagatgaagctgtttcaaaagaataaatacgaggaataagatgagaaaaaaaatactgtttttcattttgtttgtgttaatgatcaccggaattgctgtggggatacatgattattttcactggcaggtaatgcttaccacggagacttttacggaatctacggagaaaatctggaatccgaatcgtggattttatcatatttatggtttcctgatttcggatgaaccggcggatatgagtgagcagttagacaggcagatgcaaaaagatacagatcatgcccttgccatggcgcagatcaatttaagggaataccgggacaaagaaatatcaaaggaaggtctgcagaatatcgaaagactttttcaggcgatgtctgtgacaaaagagcactggatcgtacggtttttgtatgactggaatggggaaaatgagaagtatgaaccggagagtatcgattttgtgataaaacatatgcagcaggttggaggaatattaacagaatacagtgactctgtttttacattacaggggctctttgtcggcaactggggggaactcaatgggacaaagtatgcagatcagcagtctttacagcagcttgcaaaacagcttgtaaaatcgacggatagccagatgtatcttgcagtgcggacaccggtacagtggcggaagatcctggaaagtgcagatgcagacttgcaggaagatcgtaaaaatccgctgtatgacaggcttggactgttcaatgacggaatgttaggaagcggcaatgactgtggtacttatggtgaaaaaagtgccgcagaggcaggtacagatcaggcgtggaaccgcatggaagaacttacttttcaggaaaaattgtgttcccgtgtgccaaatggcggggaggtcatcatagacaatgaatataatgatttagagtgcgctattgcggatttaaaaaccatgcatgtgacttatctgaatcaggactatgatgcggcagtattagaaaagtgggcgtcatctgcggtacagacatcggactgctttgacgggatggaaggactttcgtatatagagaggcatttaggttaccgtctggtgttgtcggatgtttttatgcagcatgatttctgggaagatacggcagagataaaagtgtcacttaagaatgtcggatttgcaccggtctataaagagtgtgaaccggtattccttgtgaaagatgaaacaggtcagacgatttatgagggaatcccctcaggggatattgcgtcacttgccgggggaaatgaagcagaaaaaaaggagaactttttaacaaatataccgcttcggggtgtaaaggctggatgttacagtgtatattttgcggtgcgggatacggcgaccggcagttttatcacattcgcaaatgatcagaaaatagaacaggaaggatataagatcggaaccattttactggaatcgtaaaatggttccgattttgtttagaaataatttcgaaaatatttaagaaaagctgtccgttctcttaagagttttcccgtaagattatctgtgaaaggaaagggagggaagcttaggatggagaacagagaaaaatatctgagttttgtggttccatgttacaactctgaaagttatatggcgaggtgtatcgaatcgcttctgccgggcggagaagatgtggagatcattattatagatgacggttcaaaggataagacagtggagatcgcggatgcatatcaaaaacaatatccggatcttgtgaaagtgatacataaggagaacggtggacacggttccggtgtcaatgcgggacttgcctgcgcaaggggtgtttattttaaggtggtggactccgatgactggctggacggaactgcctatcagaaacttttagaaaaaatcagatattactgcaaagaggcgggagggggcgaagaaaagccggatctgtttgtctgcaactatgtatacaatcatctggagcagcagataacgcgcagtatgggatacgggaatgtgtttcctgcagaaaaaatctgccactggagtgagacagggcatttcctgccgtcccagtatctggtcatgcatgccttggtttaccgcacggaaatattgcggcagtcgggaattgttctgccggagcatacgttttatgtggacaatctgtttgcctactgcccgctgccgtatgtcagaaatattttttatatggatattgatctgtaccagtattatcttggcagggatgaccagtctgtcaacgagcagatgttaaaaaagcggatcgaccagcagatgaaagtgaccagaatggtgatcgcgggggcagatcttacaaaaataaaagagaaggaaccaaaactggcatcgtatatgtaccgcaatatctcgatcatgatggcgatctcatcgattcacctgcttttgatcggaaatgaggaagcactggaaaagcgaaagaatctgtggggagagatcaaaacatccaatccgaaactgtactataaattgaaatacgcgagtctgagcggatggacggatctgcccggagcagttggaaggcggctgaccattggcggttaccgtcttgcgaatgcagtttacagatttcagtaaaatgcaaaaaatagaaaaaacaggaaggaaccaaagaatatggcacacatatatattgcattagtggacacaccagggttttttgcatctctgatcagacattatctgggacagaaatacgttcatgtggtactgtcacttgatgaacagttgtcggaagcttacagttttggaagaagaaatccgtatatcccgttaattgcaggatttgagcgcgagtggagcagacagatcgcgggggcgtttccgacggctgagtaccggatctgtgaactggactgcaccggtgaacagaaagaagcgatccgtgaacgcctgcataaggattacaaaaacagattccatatgcactatgcggctgctggactgttggccctgctctgccaccggaaattttacctgaaaaaccagtatacatgttcatcttatctggcagaagtgttaggggaacaggggattttcatatcggagaaacatttttcactggtcaccccgaaggatgtctgtgaatacaaaaactgccgcgtggtgtttgagggacgtctttcagatctgatcgtgcgggaagaacaggcggttgcttatgaaacgtaagagtacagaccgaaaatatggaaaagaattttttttgtttcttgcgatcatgatgcttacatttggtgtagtcctgcgtggacaaaatttttcacaactgaaatctacactaatcagaatgaagccggtatatgtcggggcggcattgttcctttcagtattttttgttgctgcggaaggctgtatgatctgttttctgcttcgaagtgtcgggatcatagtacatgtgcgtcagtgtgttggatattcatttgccgggttctttttttccgggatcacgccgtctgcatcgggaggacagcccatgcagctttattatatgaaaagggacggtattcctctgccggagggaaccgcggtgctgatggctgttgcgacagcttataaatttgtgctgacggtcgtcggaatgatgatcctgttattctggcagaaactactgaaagagcatcttggcggatattttttctggtatatcgtgggactttccttaaatgttctgctcgtaattcttcttttatttgtcatgttaagaccggttctgatccgtcatctgaccgaaaaaataattgtcatggcacaaaaatgcggcatgaaaataccaaaagagaaatggttggaaaaactggacggatttctggatgggtaccgtggaacggttctctttttccgggatcacaaagaaaaaatactgattttaattgtgatgacatttgttcagagaagcagtgcttttctgctgacttttctggtgtatctgggatttggactgtctggaacagcgatgtaccagatcctgctgcttcaggcagccatctatgttgcggtggatatgcttccggtaccgggagcacagggaatcacggaggcgatgtatggaaaggtatttctaccggtattttcaggacagtatctggttcctgcaatgtgcgtgacaaggggagtggggttttacctgatgctggttattggagcattgtgggttttaaaaattcattataaaaaaatcggttcagggcgaaaaaaggcgtgtactaatgcttgacagcacaaaaagatatggttaaaatagatagaaataagtgaaaagaacaggggagagggaagttcgcatgaaagagtatatgaaaccagtgttatttaccagtgatgaacttgcagaaggggtatatttagcaagtggcgacggaagcggttgttatacgacaacagcatatatccatcagacaccgcagaccggaagaggtgattaccgtattcaggtgaatgccgtgcataatgcggatcatactaaagaagcacagcagttaaatatctcatttaatcagccggttacttatgtttccggtggcagggggtgcacatcaggagacggaacaagttctctttgtgtttctttgggatatcatcagaatccgaacgataatatcggttttggtgatctggttgtaaaatcggatccgggacttgcaatctcaagtgtgagtgttacggactaaggggcaggcgcaataagaaaagatagcaaatgaactgagaaataaaccagaaatgaacagatatgagagaccaatgatcatcgcatatcaagatacggcagaaggtgtgtatcttgcaagcggtggagcggctgataattcagatacggcaaataatataaagtgtgatagccagtatatgaatggtaactggcaggcaccggattattcaggctggaatggaggcaccagaggatacagacagcagttcggatgtctgggatgtccggcatatacagctacagcctgtggactcaagacgcattatgtggattcgggatatgctggaagttacaataccgataatggaaaccgcaagccatcctgggaaaagaaaggatatggaccggatgatacagtaactgactgggcgatgtaggatcatatggagttcagatggggttatcatatggtatgtgaggaagagattgcctgacatatacatgtggtaacctcttttttcgtggttcatatttgttataataactggaaatcggctagaatggggaaatattatgttagacagtctgaaattttatcataaaaggatcaaagagggtgtattaaaagatatgtggcgggagaccgtctggatctatgagtatgcgagaaagtactggaaacagatgattttttacacgctgcttggtctgtctggaacagttgtttcactgatttcaagtctgatttcaagggatatggtcgatattatcaccggaaagcaggcggggcttttggtgcgtacgttctgtctgtatatcgggttttccatagggaatatgctgatctcacaggtgaccagttatttttccaataagatcagtatcagtgtggacaatgatatcaaggcagatatttttgataaaatgttagtgacggatcttgaggcaatccagaaatatcacacgggagatctcctgacacgctggaattcggatgcctcaaacatttcaaatggtattttaagctggattccgaatctgatcatatatactgtgcggtttatcagtacgtttgcgcttgtcttttacaatgatccgatgtttgcacttcttgcgatgcttggcatgccggtcagtatgctgatgtcgaggcggattttaaggcgaatgaaaggaaataatgagaaaagcgcagctatgaatgcaaagatgtccggatttaaccaggaggcattttcgaatatccagacgatcaaggcttttgatctggtgcggctctacggggaacgtctgcgaggactgcaaaaagaatatcttggtatgaagctggagtttcagaaaatgtccatggcaacctcgatcctgttatcgatcgtcgggcttgcggtgtcatacagctgttatggatttggtatttaccgtgtctggagtggtgcgatctcctacggtacgatgacgatgtttttatcattgtccggctcactgacaggaacgctgaatcagcttgtgtcactggtaccgacggcgatttcgctgaccacatctgctggaaggctgatggatatccttggcatgccaaaagaggactattcggatgcagagcatgcggagaaattttatgaagagaaccgggagaacggcatcagtctttgcatttctaagatgtcttatacttatcacaatggaacaaaggtgtttatgcgggcggactttgaggcacatccacatgagattgttgcgttagtcggaccttccggtgaaggaaaaacaacgcttttgcgcattatgctcgccctgctgcatatacaaagcggggatgaagatctggtgggagcaaaaacaggggaagtgcttacaatcacaccggcagcacgccgtctgttctcttatgtgccacagggaaatacaatgttttccggcacgattgcggaaaatatgcggaatgtcagaccggatgctacggatgaggagatcaaagaagtactgatagtatcctgtgcctgggagtttgtacagaaactgccggatgggatatatagtaaagtcggagagcggggggtcggattctcagaaggacaggcacagaggctttcaatcgcaagggcattgcttcgccgtgcgccgatcctgcttttggatgaggcgacaagtgcacttgatgttgcaaccgagcgcagggttttgaaaaatatcatgcagacaaatgaaccgcgcacctgtatcgtgaccacacaccgcccaacggtattgtcggtgtgcaggagggtgtatggaatccgggaacagaggtgtgttgtgctgaccgcagaggaagtacagaaaatgatggatgagttttgaaagaaagcgtcttatatggcctgatcaatggcagctttcatgacggctgcagcttcgggattttttgtacaattcagccggaaaatttttgtcagcggggcaagtgtttctgcaaatgccagattttttaacagcaggtctttcgtccaggtcggggagatcatgcgctgcatcagaaaaagtgcctgttcatccggtgggagagagttcacccggttgaaaggagcctgttttaaaaacacgataccgccaagtggataggtggtggtggtgtatgtttcggacgttccgcaccagggcagaccgtatagataaggcaggccgttcttgatgccaagtacatttaagtctccgtttaaaaccggagtatgataccggttcgcccagaggttcgcgtgtgtggatttgccggtgccggagctgccggaaaagagccaggcttttccctgataaaaaatagaaacggagtgcaggacaaaaagagcctgcttttgtgcggcaatcaggaaggcaaaacgcagtgcatgaaaaatattttctacatgatctttattatcggcatcaatacagtagaggacggcggcagagccgtctttttttacgcgcatttcatggattccccagtgagtgccaaagacaaagcggtaggtgtcggtgacgtcaaagatggtaagttcagtggtgtggagcagaagtgtaccatctgcaagatgagacggtttcccggttattataaaaatgcgctgatcagccacagcagcttcgcaggagaaatctttaaaataggtatcaaacagatcgtccgggccaaaccatgaaaagcagagaccgccgatcttataatattttggagcacgatcgtcagaaaacagtgcaggaaacgtattgtcggtctgatcagaatgcggtgggaaattttctgccggcgcattgtaagagagcatgccaagctgctttaaagaggcaagatagctgtctaagtcagaggtaagctgagggagcatatcagcatctgtattgtagtaattcgccagcacagataagagcgtgcttttgtccgcacccagggagagtgtatcccataaaagtgcaccggagtcatttaggcgcagggagcgtgcatggtcggcaattttctgaccatagggcagaagatagggaatacctgcgattgttgtttttacgaatccatcagatgttttcatatcgttgtggttcctttccattacaaatgaattggaaatattatagcatttggacaggggaaatgctacaatatttcaagatgacaagctgtataaaagaggtttccgatgaaatatgatattgaacaattattagaagcgggagaggtcatacagatctatcccgaaggatacagtatgtatccgatgtttgtgccgggcagagatgccgcggtcataaaaaaagcagatgtgaaaaaaatccggcgcgcagatgttgtgctgtaccgcagaaaagggagcattctggttctgcaccgtgttgtaaaacgaaaaggcggtcagttttatatggcaggggataatcagacagaggtggaaggaccggtggaagcggaccagatcagagggattttgattgcatttgtgcggaacggacattgtatcagcgtgaaaaatccggtttatgtgattttgtcaggattgtggctgatgtttctgccggtgagagggaggttctgggcatttaccgcatgggtgcgccggctgcgtaaaaataattcagaataatttttacgcaggaaacgtgaccggttgtaatcaatattgtttgaaaatttgcatgggtgttgattttttttcacaattatgctagactcggggagttacagtaacatcgagtgttcgagaccttccactcgtaaaacaaaactaaaggagaaacaaatgagaaacaaaaaagtattacttatcgtgcaggctgcacttatcgcagctatctatgttgtactgacttattttatcagtgcattcaatcttgcttccggcgcaattcaggtccggatttccgaagcgcttactattttaccggtatttacgccggcagccattccgggactttttatcggatgcctgttaagcaatctgctcaccggctgcatgccgcttgatgttgtgtttggcagccttgcaacactgatcggagcgtgtggaacttatgcattaagaaagcataaatggcttgctccgttaccaccgatcgtggcaaacacgatcattgtaccgtttgttctggcatatgtatatatggcagagggaacgatcccgttttttatgctgacagtgggaatcggtgaagtaatttcctgctatgtgctgggtatgatcttatataaagtattaaataattaccgcagtgtgatttttaaaaacgaataaaagtttattttaaaaccaaggtctggataatgcggcggcagggacaaaacgtctttgccgccgtaaactattgtttgacaattcctctggcaatgtatacaatgatacgaggataaatagaagaaaaaacggtgtgataccgtatggaaaggaaaatacaatgaagaaaatcttagatttgattacggatgaagtgaccaaagcattcacagactgtggttatgatgcaaaatatggaaaggttactttatctaacagaccggatctttgtgaatatcagtgcaacggcgcaatggcggctgccaaagaatacaaaaaggcaccgtttatgatcgcagacgaggttgctgcaaaacttgcagaggcatccatgttttccatgacagaatccgtaaaaccgggattcttaaatttaaaactggatgagacatttttagcatcctatgtggcggacatgcaggcagatgaaggacgttttggatgtgaaaaagcagaaaatccaaagaccatcatgatcgattacggcggaccgaacgtggcaaaaccattgcatgtcggtcatttacgttccgcgatcatcggagaaagcattaaaagaattggtaagtttgtcggacataaggtaatcggagatgtacatctgggtgactggggcttgcagatgggactgatcatcaccgagttaaagctgcgccagccggagcttgtctattttgatgaaaactatgagggtgaatatccaaaagaagcaccgtttacgatttctgaattagaggagatttatccgactgcaagtaaaaagtcaaaagaggatgaggcatataaggaagctgcaatgcaggcaacttacgagctgcagcatggaagaaaaggttatcaggcattgctttcccatatcttaaacgtgtctgtgacagacttaaagaaaaattatgagaatttaaacgtatcttttgaactctggaagggtgaatccgatgcacagccttatattccggcaatggtgcagaagatgaaagatgacggttttgcctatgtcagtgacggagcattggttgtcgatgtgaaagaagataccgatacgaaagagatcccgccgtgtatgatcttaaaatcagacggtgcatccctctataatacgaccgatcttgcaacgatcgtatggcgtgaggaagattatgatccggacgagattatttatgtggtagataagagacaggaacttcatttcgtacaggtattccgctgcgcaagaaagaccggtctggtgaaaccggagaccgaattaaaattcttaggattcggtacgatgaacggcaaggacggaaagccgtttaagaccagagatggtggtgtcatgcgtttagagtatcttgtatctgagattgataatgagatgttaaagaagattaccgaaaaccagaaggcaaaagagaatcttggaatcagcgaggaagaagcaaaggaaactgcaaaaacagttgcacttgccgcaatcaaatatggagatctttctaatcaggcaagtaaagactatatttttgatatcgacagatttacttcttttgagggaaatacaggaccatacattttgtatacgatcgttcgtatcaagtcgattcttcacaaatatcatgatttaggaaagaacgcagataattcagtgatcacggcagcacattctgagagtgagaagaatctgatgttagaactgtccaaatttaatgcagtgatcgagggtgcatttaccgatacggcaccgcacaagatctgttcctatatttatgatcttgccaatgcattcaacagtttctatcatgagacaaagatcatgtctgaggaagatgagacggttcagaaatcgtatatccgtctgttggaactgacgaaatctgtgcttgagaccagcattgatctgctcggattttctgcaccggagcgtatgtaggaaaaatgtcttatttactcccggaagaaaataaggtatactgtaaaaaaatatgtaggaggaaaatcatctcctcgctcaaaggaactcggatttttcttcgaaaaacaaggaggattatatgaaaaagttaagcaaaaaattaatcgcttttgcacttgtgctagtgatgactgtcacggccggtgcagtaataccacagggaatggttgaagtacaggcggcaagcggcagggtttatgtgaatccatattcagcaactgttgtgacttataagccagggagtgccttaagcagattctcaagtgtaatcagtattatgggctgcagcaaagcaaaagaaatcaaaaatttaaagagcagtaacaaatacattaaggttgcaccgagagatggttacattcgtgttgagtttggcaagaaagcagctaagagtacgatcacatgtacggtaaaaggtgtaaagttaaaaacaacatttacagtcaaaaaatacaccaatccatgcaagacatttaaaatcggaaaaacaaacctgctttcaaaatttaataaaaatgatgtacttagaacgaacaaggcatttaaaaaacaaaaattggacatcaaactgaaaagtggctggaagatctcaagcgttcatgtgacatccggaacaggaagttataataactatagagtaaataaatccagtttctctaagaagatcacagtgtcaaacaattatggatacatatatgtgtattgctataatgaaaaaacgaaggtttctgaatgtctgcagattaatacatctacaagatactaagattgaaaaaaagaaccgtaagccggatttgacttatggttcttttttttcgaaaatacattgtcgatattgtataaaatagacaaaaaaatgaaaaaaactgttgaattttgagtgataagtactataataaagataagcaataagaaactagcatttgtacatatgggaggtgttgttatgattagtttttttatttgcctggcgttattaattggtgggtactttgtttatggtaaggtagtggagaacacatttgcaccggatgacagagaaacaccggcggtaaggatcaacgatggggttgactatgttgtcatgccggaatggaagctctttttggtgcagttgttaaacattgccggattaggaccgatcttcggtgctatgcagggtgctctctggggaccggttgtatttttatggatcacgtttggtaccatctttgcaggaggtgtacatgattatttttccggtatgctttccgaacgtaatgatggtgcttccatttcagaggtatgtggtatttaccttggaaatgtgatgaagaatgtcatgcgtgtattcagtgttgtactgcttgtaatggtaggtaccgttttcgcagtaggacctgcaggacttatcgttacactgtttaagaacagtggtgtgacaggaattgtcacaagcgcagagttctggctgtggatcattcttctttattattttattgcaacatttatttcgattgataagattatcggacgtatttacccgctgtttggtatctgcctgatcataatggcggtgggtgttatcattggtatttttacacattccgaatatacgattccggagatctggagtcatttcggtaacatgcatccggatggcaaaccgatctggagtttcatgtttatcacagtagcatgtggagcaatctcaggattccattccacacagtcaccacttatggcacgttgtatgaagtctgagaaacagggacatttcgtattttacggtgcaatggttgctgagggcgttatcgctctgatctgggcagcagcaggatgttctatttatgaggttacaggtggtttaaacacaggactcgcagagatcctttccggtggacagtccgcagctatttatgatgtatgtatcaagacaatgggaagcgttggtgtagcacttgccatgatcggtgttattgtctgcccgatcacatccggtgataccgcattcagaagtgcacgtctggtactggcagactggtttaagatcgatcaggataagatccagaaacgtctgttactctgtgtaccgcttcttgcagttggtgcttttgtaggacatctggattatgcggttgtatggagatatttcagctggacgaaccagacacttgccatgatcgtattatggacggcaagcatgtatctgttccgtgagaaaaagaattactggatcacggctgtaccggcaacctttatgagtgccgtatccatgacctatttcttctgcgcagatgagtgccttggattctctacagcagttgcatatccggtgggaatcattctggctgttgtattcttgggaatttttatccacgcaacaaagaaaccggcaaaaatgtaatacatgacagcgatgcttaacaggtataaaaagtaatacaggaatggagctgaggaagatgttgaaaccacagagactgggcaacctgtcactgcccgacatggaattgacggaagacaaaaagacatgcagaaaatttggaccatgtggtgttggtaagaaagccatttatctgaacagtttctacatagaaagaagatactatgttccgatgaagtcggtgaagcgtattttcaaaagaattgcgatgagcaaaggtggatttaccggtaaaggtgcatttggcacgctgccttatctcgtggttgaatatgatgatggcaaagaaaagcagtgcaattttaaacatgaggaggatgtggaccgcctgcttgcttatgtggaggtcaactttccgcagataccgttgcacagtgaggttgcggagcaaaaactcgcggagaaggcaaagcggatggaagaaaagcagcgtatcggaaatatttcagaaactgcaaagaaaaatatccgctgtctcgataatgcaatcaaatatcttcataaggatacagatctgtatttgaatctgagtcagtcagctaagaagaaaagagtttatgaccggagtaatccggcatacaaatgggttgcacttgcaattacactgatgggacttggagcttttgggtatggtatatattcattggctacacacgcaggatttggaatttatttccttttgttcggtcttgcagcaatctttttgttttccggtgctagtgtactgccgacgtcacataataacagaagctatattgaaaagcagttattaaatgcggtagacgagatggaacaatatatcaaaacatatcctgatttcccggttccggcatgttatgcacatccggttgtactaaagaggatgcaggatattttaaaggaaggacgcgcagagacgataccggcggcacttagagtgctgaaagaggatttaaaagcgttaaattccagtgtggtagtggaacaggaggaatacgatgaaatcgtagccatcaaaccgatgttccttgtaatggattacagataaaaaataaaagaaaataccggcggcgaaacgttaagaaaagtcttacgtttggcaggtcggtatttttatgcataaaaataagcctgtctcatagaatgaattaaaagaaaagggaggaggcatatggaaaacctaaaagttttgtttccggtacatatcagaaaaaaaataaaaaataatctgtggctgaatgatcttgaggaaatccggatccgggcaggacagccaatcgagcttgcgtattccgggaaaacacgttatctgacggatatggacggtgaaatgtgtgcctgtgtcagagaaagcgtacagaatgcaagagcatgttacagaataacgggcgcagatattgcagagatgttaagctatatcagcgagtattccctgtatgcataccaggaggaactaaggcagggatatattacaattgagggtggtcaccgggttggaattgcaggggagattgcaaaagacagggaaggtattacagggatcaaatatattagttttatgaatatccgtgtggcacatgaaaaaaaaggatgtgcagaaaaaattctgccttttctgaaggacggagaaagtatttataatacactgctggtgtcaaaaccgggtgcaggcaaaacaacctgtctgcgggattgtatccgcagtctctcaaatgggaaagaaggctgggaaggtatgaaaatctgtgtggtggatgagaggtctgagattgcagcctgtcatcttggaattccacaaaatgatatgggaatacgaacggatgttttatctggatgtgggaaatcagagggaatgatgctcatgctgcgctccatgtccccgcagatcatagcggtggatgaacttggagggaaaaaagattttcaggcagtcgaacaggcagcctgttccggggtacggattcttggaacagtacatgcggatacggtggaagaattatgggagaaaccatatctgaaaaagtggatgaagcgtggaatttttgaacgatttattctgatccggcataaccggtccggcgagcgggattttcaggtttttaacggaaaaagagaacagttatgctaaagctgataggtggtattctggttgcaggttccggggttggacttgcagtaaacatgatcgctgaaatcaggcagcatctgcttagattgtatgaaatccgtcagcttctcataaatatttcgggagaggcagcacttgcattacttccgatggagcatattttgaatcaaccgacgctgacgaacgatgtggtgttgcaaaaagtatgcggacagattgctgatcgtcttgctgcaaaaaagggagaaagcggaggtgaaatctggtgggatatattttggaaaaatcgaaaagaattgggaatctgtgcgtctgaacttgagattattgcgaatgccggaaatgctttttttggaagaaatataaaagagaatgaaagaatgctttctatttatttagagaggcttaattttgtgatcgaacaagagcaaaaagagcagagagaaaagcagagagtggccggggcggtcagtgtaataggaggaatgatgttagtgatactttttatataacgcaaaaataaagtgtgtatacggcaagcaagagaggggactggattacggatgagtgttaatttgatatttaaaattgcggcggtcgggattttagtcacggtcatcagtcaggtgctaaaacatagcggaagagaggaacatgcatttctgacaagccttgcgggattgctgattgtcctcttttggattgttccttatatttatgaattgtttgaaacaatgcagtcactgtttgcattataagatgttacagaatgggaatgaggcatgaaatggatattttaagaatagcggttcttggtatcgcaggagtacttctggcacttttactgcagaaagaaaaaagtgaatacagcatgtttatcagtatggcagtctgcatctgcatttttatttatattcttggaaaggtggagactgtcatcaattttgcaaaaaaaatgcagacgtttgttgcagtggatcagacgtatatcacactgatattaaaaatggttgggatcacctatgtggcggagtttgcgatgaatatctgtaaagatgctggatatgcggcagtcggaaatcagatcgaactgtttgctaagctgtcgattctggtgcttagtattccggttttgacggtttttttagagacagtcgggagctttttatgaaaaaatggggagtgtgtgtgatatgtattctgttactctgtgtgattgagacggttccggttttcgcatctgaaaaaaatactcaggattatttagggaacatgacagaagaactggatttttcgaagctggatcattttatgagacaggatgcagaggatagtgggattacattttcagaactggtgaaagaactactgtatcaggagaagccaggggcgctgtatcagcagatcggaccatggctaatggggcaattatgtgagtcagtctgtgaaaaccgcaaaatattagtggaggtggtgctgcttgccgtgtgtttttctgtacttaaaaattttgccggtgcgtttgcgtcatcttatgtatcagatctttgttttatccttgtattctgtgtattagcagtcttgatgctgcagtcatttctgacgtttcgtgagattgtgtgcggtgtattggaaaagagtgtggatttttttcagatttttataccgacatttagtattgcaatgcttttttcggcgggagaaagcattgcatcgggcttctatcagacggcttttctgatcatatatctgatcgagtggctgtttttaaccattttagtgccaatgatccatatttatatactgactgtgctgatcaattatttctttgaggaagaaaagtttgcaaacatgatggaattgattggaggactgatcgggtgggcaatcagatctgccggaatcattgtacttgggctgaatgttgtgcaggggatcgttgcaccggcaaaggacaggctgctttatgggacagcaggacgggcaatggcaatgatacccggaattggtaatacagtgaatggtgtcagtgaacttttgcttggttctggaattatgatccggaactgtgttggggcagccgggttgatcgtactgattattttagtggcagtgccgatggtacaggcaggctgtatggtacttttttataaaattgcagctgctgtggtggaacctgttgcagataagagaatcgccggatgtttaaagggaatggcacagggggggatgctgtacctgaaattgatgggatattgtgtgatgctgatttttctgacgatcgcgcttacggttgcttcctccgggtttggctattaagaaagtgagaaacggatgaacgtattgatcgggtatattcaaaaaatttttgccctttttctgttgcttgtggttgcaagacagctgatcccgaatggaagattaaaaaaatatatttatttttttacggaacttgtgctcatcattggtgtcatgcagccttttttttctttttggggggataatgatgctttgcttgataagatcaggtctgaaacgtttacggaaaatttaagtgaggcttcaagagacatcagccgtatggagtatttacggaatgattattaccggaaagaatatgaggatgcggcggcactggatgtaaagggaactgcagaaggatatttagaacagtttggatttatggtaaagcaatcatcggtggaactgacagaaaattatgaagtgagaaaaattatactcacggtagcagaaaaagaagccagggacacagaaggaatctttgtggaacagggaaaagcgcagggcagccagattgtgcttgacgaactgaagcagaaacttgtgcaatattatggggttaaggaagatcggatacagatttcgtatggtggtgaaggatgacggagaaaatcagagaatttttgcagcagaaaaggtggctccagttaaaaaaaacggactggatcgcagttgctcttgttggggtgcttcttcttgtggtggcaatgccttccggtggatatggaaagtatttagcagaaagcaaaaaggaaggtaccgcacaggagaagacggaacagaaatacgaaaaagaggactatgcggaatatttagagcataaattagaacaggtgttaggacagatggaaggagtggggaaagtttctgtcatggtcacggtggcagatcagggggaagatatcatagaaaaggataagacagagcatacgtccaccgtcacaaatacggacagcgggagtatggagatgacgacggaaaaggaaagtggggaggagacggtatatgaggagagcggcggcgaaaaagcgccgtatgtcagcaaagaaatacttccggagatcgagggggtgcttgtggtggcagaggggggagacagcccacggatcgtttctgatatttcagatgccgtaaaggcattatttcaggtggaagcacatagaattaaggtagtaaagatgagttcgaaggaggatggaacgtgaaaaagatatttcagaaaaaccagctgattattacagcactcgcgttgatgattgcggtggcgggatatttcagttacatgaacaatcacattgatgacggtacggcagcggagacggcggcaaatgcaggtacagatgcactcaatgcagaatatgagatctcggatgaagatccactggctgcagaagatatttttacggatgagggaaccggggaggaacttgcacttgtggatgggacggagactgcggatgcaggaaccggcgaagatacatacgatgcggcagatgcagctgtgacggacggtcaggatgttgcagaaaatgcggcagatggacagaatgcggtggcagatgtgagcgcagatgcagcggatgtggcagacatgacgtcccaggatgcagaggagattgaaaatcccggggaggcggttctcacaagtaccggcactgcaaatctcgactatgcagcaagaatgaaattaaaccgcgaacagatccggtctaaaaataaagaggcgttattagagatcgtaaacaatacatccgttgcagataacttaaagcaggatgccgtgaacaagatggtggcaatgacagatatcgcggagcgagaagccgcagcagaaatgctcttagaggcaaaaggattttcagatgtcgtggtcagcattaccgatgataactgtgatgtcgtactgaatatgggagaagtgactgatgcaaaaagagcacaggtggaggatattgtgaagcgaaaaaccaatatttccgcagataagatcgtgatcacaccgatcgtggtaacagacgccgagtagggcgtctgtttctttgcattttacttgattttttcatggttacggtttatcctagtacggtagaaagagagtacattgtgcgaaatggatttttacatgcgggaatggagacttttaatatgaagagagtatttttgatcgtacttgacagtgttgggatcggggaaatgccggatgcggcagattatggcgatgctggaagcaataccataagagcggtagcatccagtccgtatttttcgatgccgaacatgaggaaacttggattttttaatatagacggagtggagatcggagaaaaagaaaagaatccggccggatctttcgcgagaatgacggaggtatcgaaaggaaaagatacgacgatcgggcactgggagattgcgggcatcatctcaaacagtccgctgccgacttacccggatggatttccacaggaaattttagacgagtttacgaagagaaccggaagaggagtgctctgcaataaaccgtattccgggacagatgtcatccgcgattacggcgaagaacacatgaaaacgggaaaactgatcgtatatacatctgcagattcagtatttcaggtggcagcgcacgaggatgttgttccggttgagacactttacgaatactgtaagatcgcaagggagatactgaccggggaaaacggtgtgggacgcgtgatcgcaagaccgtttgtcggcacgccgggcaattttacaagaacggtacgccgtcatgatttttccctgcagccgccgaaggtgacgatgttagatcagttgtgcggacatggatatgatgtgcgttccgtgggcaagatcattgatatttttgcagaaaaaggaatcaaagaatatgtgcgcacgactggaaatgaagatggaatcaacaagacgatcgagtatatgaaacaggattttgagggactttgttttacaaatcttgtagattatgatatgctctacgggcaccgcaatgatgtggaaggctacgcaaaggcactgacttattttgatgagcgtctgccggagctaatagctgcaatgagagatgaggatatcttaatgatcacggcagatcacggctgtgatccaagcacaccgtcgaccgatcattcgagagaatatacaccgcttgtgatgtatggaaaaccgatcagagcgggtgttaattacggaacaagaggttgcttttcggatattgcggcaaccattcttgcttattttgacattaagccggagtgtgcgggagaggcaatcccgattttataaggatttttggaggataaaatagttttggctgatttaagaaaagagatagaaaaaagacgtacatttgcaatcatttcccacccggatgcaggtaaaacgactctgacagagaagttcctgctctacggaggagcaattaatcttgccggttccgtcaagggaaaggcaactgcacgccatgcggtatctgactggatggagatcgagaaggagagaggtatttccgttacttcttctgtgttacagtttaattatggcggctactgcattaatattctggatacaccgggacatcaggatttctcggaggatacttaccgtaccctgatggctgcggactctgcggtcatggtcattgatggatcaaagggtgtcgaggcacagacgagaaaattatttaaggtctgcgtgatgcgccatattccgatttttacttttatcaataaaatggaccgcgatgcgaatgatacgtttgatctgttagacgagattgaaaaagaacttgggatcgcaacctgtccggtcaactggccgattggttccggaaagaattttaagggtgtatatgaccgtaacacaaaagaggttatgacgttctccgacacgttaaagggaacgaaagagggaaccgaaaagcatattgcagcggatgatcctgcactgatcgaggagatcggacaagacgcatacgataagctgatggaggagatcgagcttctcgacggggcaagtgcagagtttgatatggatcttgtcacaaaaggacaactctccccggtatttttcggatctgccctgaccaactttggtgtggagacatttttacagcatttcttaaaaatgacctattccccactgccgcgtaaagctgacatcggagaaatagacccatttgatgagcatttttccgcatttgtatttaaaatacaggcaaatatgaataaggcacaccgtgaccgtatcgcgtttatgcgtatctgttccggaaaatttaccgctggtatggaggttacacatgtgcagggaggcaacaaaaagatcaaactgtcgcagccgcagcagatgatggcacaggagcgccatatcgtagacgaggcgtatgcgggggatatcatcggagtgttcgatccgggtattttctcaatcggagatacgcttaccacagcaaaaccgttccagtttgagggaatccctactttcgcgccggagcatttcgcgagagtgcgccaggtggataccatgaagcgtaaacagttcatgaaaggcatgcagcagatcgcgcaggaaggtgcgatccagatcttccaggaatataatatgggtatggaagaagtcatcgtcggcgttgtcggtgtccttcagtttgatgttttaaaataccgtctggaaaatgaatataatgttgagatccgcatggataacctgccatacgagcatatccgctggatcgaaaacgaggagatcgatatggacaagcttgtcggaacttcggatatgaagaagatccaggatttaaagggcagaccgttactcttatttgtcaatgcatggagtgttggtatggtgcttgaccgaaatgagggactggtgctctctgagttcgggcgtgagtaaaggacaggtttagctggcaaaatctgtaatacgcgggtattgtcagttaagtgaatttagacagcaggaaaaggaaaacagaaaatggcagttatcacaatcacaaaagataattttgaaaatgaagtactcggtgcaaaacttccggttgtattagatttctgggcagagtggtgtgcgccgtgtaaaatgcagtcaccggtgattgaggcgcttgcggaagaattagaaggcaaggtcatcttcggtaaagtcaatgttgacgaggaggctgcgctggcattgaaatatcagattatgagcatcccgacgctggttgtcatgaaatacggattatttcagaaccgtgcagtcggactgcagacaagagaagagatcatagatatgatcgagcagatcaaagaagactaaaaacaatagaatgcacactttgcgaacattctattgtcatgaataatagaatgctcgcttcacgaacattctattatgatgaatcacttcaggcatagccgtgcgaaactcatcagcagctgtgagtttcacatggctatgccttatttttctgataagcagccttttccgcctgcatttccaaatacatccgcatcacattccatttccgatttgtcggcgtaagcactgctttataatctatgacaacctgatccctgcggagagatgctaaaagtttatccatctttttctctgtaaaatcacagaaaacaatcagactttccgcaggaaccttcccggaaaaaggctgaatcaaaggggaagcagtcttatttgcaatcatctccaatggttttaaataatcagaggaaggaacctcctccacacggaccttcaaagcccccgtgatctgctttaattttttgagattgttgtcatctaaatgaaataccagtaatttttccatgtgtaactccgtttcatatttatagaatagacatattataagagttttgcagcagggtgtaaatatgttttatagcaaagattaagctgcaaaaaggtgtatcaaaacctgatggccggcaaatcgcacaaaacagacccggcattgtgcaatttgccattcacgaaactcagttacaccttttgcagctgaacacagtcttaactttatggcaagtcttaattttatgaaagaaactacttgtaaagaaaccaccactatgatacacttgtcgataaggaaaatcatttccgctaaggttgtcagataaaaatcttcaccgccctttggtggcggttcacaggcagaaatctgccggtttatcccataaataaaaagaaatagcataactggaaaaggtgtgctgcagactgtcatatgtcagatggggaagcatatggaaaattgcagacaattttgtggttgacatttcgggaaaaatataatactattagaacagaaaaaacgaacataagttcgcacggaggaaagaaatggcaaaggaagataaatataaagagatcaatgcagtaaaaaatgataaattaaaagcgttggatgctgcaatttcacagattgagaaacagtacggcaaaggctccatcatgaaacttggtgataattccgcacatatgaatgtggagacgattccgaccggatcattaagtcttgatattgcacttggtttaggtggacttccgaaaggaagaatcatcgagatctatggaccggagtccagtggtaagacgaccgttgccctgcatgcggttgctgaggtacagaaaagaggcggtatcgcaggatttatcgatgcagagcatgccttagatcctgtctatgcaaagaatatcggcgttgacatcgacaacttatacatatcccagccggactgcggagagcaggcacttgagatcacagagaccatggtacgttccggggcggttgatatcgtgatcgtcgactccgtggcagcactcgttccaaaggcagagattgatggagatatgggtgattcgcatgtcggacttcaggcacgactgatgagccaggcacttcgtaagctgacttctgtcatcagcaaatccaactgtgtggttatcttcatcaaccagcttcgtgaaaaagtaggcgtaatgtttggtaatccggagacaacgaccggtggacgtgcactgaagttctattcttctgtccgtatggatgtcagaaggattgaggcattaaaacagggcggagaggttgttggtaaccgtaccagggtaaaaattgttaagaataaggtggcaccgccattccgtgaagcagagtttgatatcatgtttggacagggaatttccagagagggcgatatcttagaccttgcagcagataagggtgtggttaacaaatccggagcatggtatgcatacaatggagataagatcggccagggacgtgagaatgcaaaacagtatctgaaagaaaatccgctgatctgtgaggagatcgaggcaaaagtcagagaaatgttaaatgtggacggaacggaagagtctgaggaaacaaaggaaaacgagactgaggcacagagcataaaagcagcggaagcgatcgcaaaaaaagcggaagcggctgaaaagaaagcagagaatacagccgaggtaaaagcggaggaataaaagatgcaggagttgcttgtcgtagaagtaattccccgggaaaaaggaaggacttccattcggtttgacaacgggatggaagtccttttatataagggtgaggtaagaaaattatctttgcgggaggggaatgtcatatcccgggagaaatatgatgagatcatctatgaaatacttggaacgcgggcgaagaaacgtgcgatgtttcttttggaacgaatggaccggacggaacatcagctgcgggagaagctgatgcagaacgggtatcctgatgtgtgcgtggatcttgcagtggagtatgtcagaaaatatcactatatcgatgatctgcgctatgcgacgacctatatttcatatcaacagaagaaaaaaagccgtcagaaattaaaaatggatcttatagcaaaaggaattgaaaaaagtgtgatagaacaggcacttgatgaggtgttcgacagtgatgaacagttaaagatccgtcagcttttagaaaagaaacattatgaaccaaaagaatgtgaccgcaaagaacagcagaaaatttaccagtatctgatgcgccgtggatttaagagcagcgatattttgcatgtcatgaaaatctgggatgaatacgaggaataagaacataggaaaacgggggatttttggtacaatatgttgtattgttgcaaaataaaaatgcaatattatgcacattgaacagttatctacttgacataaatattaaaatagaataaaatttatatgttgtaattatgacagataacaaaccatgtttttatgttatatgtacaatgaaaatttaataaaggaggtgctcctgtgggaagtgtgattatcgctgttgtgatcactctactggttaccgcggtcgttgtatatttcgtcacaactgcttactataaaaaagtaacagaggctaagatcggaaatgcagatgaaaaagcgcgtgagattattgatgaagcggtaaaaacggcagaaaccaagaagcgtgaagcaatgcttgaagcgaaggaagaatccatccgtgtcaagaatgacttagacaaggaggtaaaagagcggagagcggagatcggacgcagtgaacgacgcattgttcagaaggaagaaaatctggacaaaaagttagaagcgatcgaaaaacgcgaggcgggatttgcagccaaggaagaagagatcaacagacagaaagcgcaggtcgcaaagctcaatgaagagcgtgtgaaagaactggaaaggatctccggtttaacctccgaacaggcaaaggattatctcttaaagactgttgaagaagacgttaaaattgatactgcaaaattgatcaaagaaatggaacacaaggcaaaggaagaagctgataagaaggcaaaagagtatgtggtgactgcaattcagaagtgtgctgcggatcatgttgccgaaacgacgatttctgttgtacagcttccgaatgacgaaatgaaaggaagaatcatcggacgtgaaggacgtaatatccgtacgttagaaacgttaaccggtgtggatctgatcattgatgatacgccggaggcagtgattttatccggttttgatccgattcgtcgtgaagttgccagaattgctttggaaaaactgattgtggatggtcgtatccatccagcaagaatcgaggaaatggttgagaaggctcagaaagaagtcgagacaatgattcgtgaggaaggtgaggcagcaaccttagaggttggtgttcacggaatccatccggagcttgtgcgtcttttaggccggatgaaattccggacgagctacggacaaaatgctctcaaacattccattgaagtagcacagctttccggattactggctgctgaaatcggtgtagatgtaagaactgcaaaacgtgcaggattgttacatgatattggtaaatctgtcgatcatgatatggaaggttcccatattcagatcggtgtggatttatgtagaaaatacaaagagtcaccaattattatcaatgcggtagaagcgcatcatggtgatgtagaaccggagtcattaattgcatgtatcattcaggctgcagatacaattagtgcagcaagaccaggtgccagaagagagacactggaaacatattcaaacagattgaaacagttagaagatatttctaacggatttaagggtgtagaaaaatccttcgctattcaggcgggcagggagattcgaatcatggttgttccggagcagatcagcgatgccgatatggtattgcttgcgcgtgatatttccaaacagatcgaagctgaattggaatatccgggacagattaaggtaaatgttattcgtgagtcaagggtaacagattacgcgaagtgattcgtgacaatggggttgctcgcagagcgtgcaatctattgtatgaaaaataaagagactgccgtaccggtgtcataaatgaccggtacggcagtttttgcatatatggaatcagagaaagacggaattctgaaaaaaatagtgccaggatgtaaaatatatgttaaaatacatctgaaaatgagtgaaagaaaggtggtgtggcaaatgcagagagtaaaacagcataagtggtttctgtttatcctgattggatttatcgtaatatctttctttcagtttttaccgctgacagatacactgcatttgtatgaaaagacaccgcagagttttgaactgaccgcaggcgggctcctgaagtatggaatagaaggacaaaatgcagaccaggcaggggaatgtgaactagaagaatatcacacagaccggttgacgggaccggaaatagcagaacgtcaggcatgcggtctcccggaagaaacaccggcggctacactggcgcgaacgacacagagtgaagctgcgctgggtgaacagaatcagagccgttttcagatgttacggtttttagtagaagtatatgtacttttaatgatcccggcagttattctgcatatggcactaaaaagatttagcagccatatgatcatactgtggcagaatataaaatacatacatcttgttgatggtaagaaggcaaaacgtattcctgtaattgaataaaaagatgatattacaggaggcgtattaacgtgatagaaaatagaataagtgacagagcaaaaatattactgatcgatgaggatacaagcatttcttatctgatccgcagggcaatggaaaaagaaaattacaagatttatattgcaggaagtggaaaacagggaatggagatgagtaccggtgtctgtccggatctgattctgatggataataaattttctgatatggaagggatcaccttgatccagtggttcagggagtggacggattgcccgattataatcctgtcggaacggagcagctaccttgataaagtggaggcattatatgccggagcagatgattatatggtaaaaccgtttcatgagaaggaacttgcggcacggattttttccgcattacgcagaagaatttcggcaggtgcgcatacatattacgaggcaggaaatcttaaggttgattttacaaaaagacaggttttgcttggaggaacggaggttcatttttcaccggtggaataccggatcatagaaagtcttgcgttaaattctggtacggttgtaacatatcagatgcttttggaaaaaatatggggaccatatgcagagcaaaacagcaggatccttcgtgtcaatatgacgaatatccggaaaaaaatagaaagttctcctttagaaccggagtatattacaacgatcccgcgggtaggataccggatgttggagagtcaggctgagaaaggtggcatgcagatgctggaaaatcagactggcagaaacatgaaagtgatggaaggtcagaatatcagaaatggtatccgtatgatggcataaaaataagctgcacacagaggtgtgcagcttatttttttctggatgtacgataatcttttgactgacagtaagaatcgtaaattgcgtaaacaaaccctccgatgataatgccaatcccgatgacagaaaaaacaatctcaatgactgtcatagtaaaatctccctttcgtaaatttgatgttatcagtataacagtcaaacttataaaagggagatttttgtgtattccttaatcttttttggaaagagaagaggaaagttttaacgttttatttatctgccgctttattttttgcttttagacgttgttttgccaagtacatctgttcatacgcacgtgataagagctgatggaaaggtgtgtcagtgtccggtgctatgccattcacttgcctgcgaacagtaacaagtcgccttcgtcgtgtccaaattgtataaaagcagatggaaaataaaggcagagggtggtacaataagaacagatactgtaaaaaaataacagacttggaatatattgaagcggaggaatattgtatggaccaacaggttaagagagtaaaaagagaactggtaaaaaatggagccattctggatatttatacagatacgatgcagctgccggacggaaaactcgaagaatgggattttatttcacacagaaaaggggcggcagccgttgttccggtacgcggagacggaaagattctgatggtgcgtcagtaccggaatgcaatcgaccgtatgacacttgagataccggcgggatcaagagacagtgttacagaagacacaaaggtgtgtgctgcacgggagttagaggaggaaacgggataccgcagtgatgatcttacgcgtcttttgtcacttaaaacaacagttgcattttgtgacgagttcattgatgtgtatttagcgcgtaatttaaaaccgggacatcagcatttagatgagggagagttccttgatgtcgaggcacatgacatcgatgaactctgtcagatgatctacgatggaaaattacaggatgccaaaacagtttctgcacttttggcatataaaaatcttctgaatcaggagaaaaacgcataaactgaagaaaagtgtatgtggggcgtgtgtgaaaaaagaaggatgcctgtttctgcctgtattttttgtgggtgtttttcttgcaaacttgttaaagtataaggcaggggatctttgccggatattaaatatatggattttagaacagttcgcatatagcagcatttcaccggaaagactgttctggcagctgctttggaaacggggaaagtttgcattttttttctttttgtttggggaagggtgcggatatgcggtggcatcgacggtatggttgtgtattctgacaggaacatttggattttttcttgcaatggcgattgcggatcttggaatccgtggtgttgcagttgcgtttgtcggtctgcttccacaggcatttttttatgtggctgcggtactatggtgccgcttttgtggcaaaaacagcagacagtaccggccaccggtatgtaatccgaaaatccgcataaaacaggcggtggaatctgttgtattttatggggtggcagtaatactggtaatcggcggcgtatttgcagaagcttatatcaatattccgctccttaagatgatcgtaaaaaatttttgaaaagattgcttttcggtctgcttatcattataatgaaaaaatacacaggataaaaagaaagtcaggaaaaaaacatgacacatgacattatggattttattgaatatattcacaatgaaaaacagacatcaaagaatacggaagtttcctatgaacgtgatctccgcaagatgaatgaatatctggaagcgcagaatgtatacggggtgtctgccgttacggagacaaatctgaatgcatatgttatgtttttagaacgtgaaggacggaaaccggcgacggtttcaaggagcattgcatcaatgaaagctttttttcattttcttgaaaaggagcggagaatcgagtcggatccggcatggcgtttgaaagcacctaagattgaaaaaacgatgccgcgtatcctgaccacggaagaagtgacgcttttgttagagcagccgtccggaaatacaccgaaagagctgcgggataaggcgatgcttgaattgctttacgcgacaggaatccgtgtgtcggagctgatatcgttaaaagtctcggatctgaatcttcagatggagtatgtgatctgtacggatatccataaagaacggatcattccatttgggaatgtcgcaagggaggcactgacaagatatatgcaggatggaagagatcatctgatcagccaggcggactgtccgtggctgtttacgaattgtaccggtggtgcaatgagccgtcagggtttctggaaactgatcaagttttatgggaagaaggcggggatcgaatcggagatcacaccgcatacgctgcgccattcgtttgcggcacatctgatcagcaatggagcagatttaaagtcggtgcaggagatgttaggacattctgatatttctacgacacagatttattcgcagatggggcagggaagaatccgggaagtgtatctgaaagcacatccgagaggatagtagtagaaacaatagaatgcatgttctgcaaacactctattgtcatgaataataaaaaaggaactcacagaaatggagttccttttttcattatgagatttcaagaagctgccggtacaggtaaaaaatcttaacggcacatatctgcaatcgtataaatcagatttttggaatcttcccagccaaggcaaggatccgtgatggatttaccgtagatgtgttcgccgatcttctgggagccttcctcgatataactctcgatcataacaccttttaccatcttctgaatttcagaagaaacctgacggttgtgcatgacttcctttacgatacggatctgttctttatattttttgccggagttggaatggtttacgtccacaacggctgccggattgacaagatccattttttcgtacatgtcacacagacggatcagatcttcgtagtggtaattctgtgtggagttaccgtgtttgctgactgcgccgcgcagaacaacatgtgtcagcgggttgccgcttgtctccacttcgtaaccacggtatacgaaatgatgtgggtgctgtgccgcatatacggagttgagcataacagaaaagtcgccgctggtcgggtttttcataccggatgcgacatcaaaaccactgaccgtcagacggtgctgctgatcctcgacagaacgtgcaccgatggcaacgtaggagagaagatcttcgacatacccccagttttccgggtagagcatctcatctgcacaggttaaaccgctctctttaatcgcacggatgtgcattttacgcatggcaatcagaccttcgatcatgtcaggcgctttttccggatccggctgggaggcgatacccttatagccctcgccggtagtacgcggcttatttgtataaacacgcggaatgatgatcagacggtcggcaacatcctcctggatttttgtgaggcggctgacataatcacagacagcgtcctcccggtctgcggaacaaggtccgatgataacgagaaaacggtcatcttttccggtgataacgtcggagatcatagcatcccgttctttttttaactgttttaattcttctgacagcggaaaatcacgtttgatctctgccggagaaggaagctggtttaaaaatgtaaaactcataataatcctcatttctgagcaacttattgcgaaaaataagctatcaaacttatttttcacactaaaaactccattctaagcgctaaaatcaaaaattatattaaatgatattgcagaagatgtcaaatatttgcataacaggagggggttggttataatgaaaaaagaagatgattgtgagatggcagggaggtgtctggcatgaaaataaaaggaacagaggtcggaacgggacgtccgctcatatgcgttccggttctcgaaaaaacgaaagaagaagttataaaagaagtggaatatctcgtgaaatcggatgcagacatgatcgaatggaggctggatgcatttgaacattacaccgactacaatgaagtgcgggaaatattgcagcagatagcgcctttattaaagaaaaaactgtttttgtatacatttcgtactgcaaaacagggtggagtggtgtcggttgaccgggaaacattaaatgatctgcacgatcttgcggcagagtcagaatgtgtggatctgatcgatctggaattttttgaggaggaacatgcggcaaagcggatccgggaaattcaaaaaaaggggaagaaagttgtggcatcacatcatgatctggaaggaacaccacagatagatgtaatgcggatgctgcttgaccatatgtgtgaaggaggtgcggatattgtcaaacttgttgtgactccaaaaacaacggaagatgtattgcggctgcttgccgttacttctgaatttcacagtgaaaatcaggaaacaccgatcattaccgtgtccatgggaaaactgggggcagtcagcagagtgagcggagaaacttttggttcctgtgtgacatttgcgtcgcatggaaagaaaagtgcaccgggacagtttcaactggaagaaatgcagcaaacgctcgctatgctgcatgagggatgtgaataaaaaataaagaaaatataaagaatggataaagtgcagggaagatacttgacgtggtatcttccctgtgttaatatatgccactgtaaataaataacaaagaaaatatataacaatgttaaataatgagatgagaaaaacaggaatggatgatttatttacaagatttttttttgcgctgtatcagtttcacaaactgcatatgggtgatctggtgccggatatcacgaaacttgagggcatgacgatggcggcgatcaagcactgcagtggggaaaaggaagaactgacggtttccgaattgaccgcaaagctgaaagcgaagggacctgcagtttcacgcaccttaaagacgttggaagataaaggatacattgagcgcgacgtcaacaaagcagacaggcgcaatacttatgtgaagctgacggcatccggggaacagaagcaggaagagtgcgagcagatcatgagcagctttgcgcatgcagtcatctcaaaaatagaccgggatgacatggaacagctgatcgattgcctgaatgagctttacgaggcgtcgagggaagaaatcgaagaccgaaaaatgagacaaaaaggagaataggacatgagcaaaatatttaaaaatatgctcccgtactggaagggactgatcattgttgttgcactgttagttgtacaggcgtggtgtgatctgtctcttccggcatacacatcggatattattgatgtcggaatccagaacaaaggtgtggagcatgtgctgccggaggcagtaacggaggacgagtttacactggcacagctttttatgaccgatgaggagaaggaaagctgggaaaacagttacgaaaaggacggagatgtttaccgtctgaccgttacagataaaaaacagttagatgaactggatgatacgctgcttcttcctcttctgatgaactatcagatgtcatcggtggatgagcagacatttaaagagagtgtggcaaaacagaccggaatggatcaggcgatgcttgataacatgagtatcgagcagatcggggagtccatgggagtgccgcttacatcttttgagaaagaagtcgaggatgacgacggaaataccgtggttacgaattgcgtggatatgcgtacaatttttgccgccatggaagcgtcaggggcaatgacagaggaacagatcttatccatgcgtgataccgtttctgatacgatcgataccatgggaagttctctggtaaaatcaatgggtatcgcgtatgcagtaagctgtgatacagcggcaggagtggatattgataaggtacagacatcctatctctggtcagccggtggcaggatggttgcgatggcacttcttatgggtgtggcaacggttctggtaggattttttggtgcacgtatcggtgccggaatcggacgtgacctgcgaggaaagatatttggacaggtggttcgtttttctaacgcggagatggatcatttttccactgcatctttaattaccagaagtacgaatgatatccagcagatccagatggtttccgccgtgatgatccgtatggttgcctatgcgccgattcttggcatcggaggtgtattaaaaatcatccagacaggagcaggaatgggatggatcattattctggcaatccttgtgatccttggctatgtcatggtattaatgtctgttacaatgcctcgttttaagctgatgcagaaactggtcgataagatcaatctggtatccagagagatcttaacaggactttccgtcattcgtgcattcggcagggaaacagaggaagaaaaacgttttgatgctgcaaataaagatctgacaaagaccatgctgtttacaaaccgtgtcatgacatttatgatgccgggtatgatgctgattatgaatcttctgaccgtaggtatcgtatgggtaggcgcgcacaaaatcgatgccggttccatgcaggtcggttccatgactgcattcatcacctatgcgatgatgatcgttatggcatttttaatgctgacagcaatgtcgatcatgcttccgcgtgcagcagtggcagcagaacgtatcgatgaggttatccgcacagagtcttccatagaagatgcaaaaaatccggaagaattaagagaacacaaaggtgtgatccgtttttcacatgtcagcttccgctatccgggagcggaggcagatgtgttggaggatattgattttacagcggagccgggtaagacaacggcaatcatcggaagtaccggatgtggaaaatccacgctggtcaacctgattccaagactttatgatgtcacaggcggaagtgttaccttagacggtcaggatatccggaatatccgtatggaagatttgagggaagaaatcggttttgtgccgcagaaaggtgtactgttttccggtacgatcgcgtcaaacctgcgttttggaaaacgagacgccacagatgagcagatcaaagaggcggcagcaatcgcacaggcagccgattttattgaggagaaacaggaaaaatacgacagcgatattgcacagggcggaagcaacgtttccggtggacagaaacagcgtcttgccattgcacgtgcgattgcaaaacagccgaaaatctatgtgtttgatgacagtttctctgcacttgacttaaagacggatgcggcacttcgaaaagcactggcatcgaaagtaaaagatagcacagtcatcattgtggcgcagagaattagtacaattttacacgcagaacagatccttgtgcttgatgatggaaagatcgtcggaaaaggtacgcatgaagaattgctgaaaaactgtgagacataccagcagatcgcccgttcacagctttcggcaaaagaacttggcatagaggaaagtgaggtgtctgtcaatgagtaatgaaagagaaaaagttagaatgcagcaccgtggcagaggaccgatggggcgcggcatgcagccgggagaaaaaccgaaggatttaaagagttctctgggaaaactgttatcttacattggaaattttaaagctgcaattattgtagtcatgatttttgcggcggcttccacggtatttaatgtaatcgggcctaagactttaggaaaggcaaccacagcgctctccgaaggactgatggcaaagatccagggcacgggaagcatcgattttacctatatcggacagatccttttatttgtgttagggctttatgtgtgcagtgcggcatttaactttatccagggctggatcatgaccggtgtaacgcagaagatctgctaccgcatgcgtaaagaaatctccgggaaaatcaaccgcatgccgatgaagtattttgagagccgtacttacggagaagttttatcgagaatcaccaatgatgtcgataccttaggacagggattaaaccagagtatcacaacgatcatcacgtcggttgcaaccttagtcggggtgctgatcatgatgttaagtatctccccgttaatgacgctgattgcaatcgtgatcctgccgatctccatggcactgatctcatttgtggtcaaaaaatcccagaaatacttcaaagaccagcaggaatatttaggtcatatcaatggacaggtcgaggaggtttatggcgggcatttagtcatcaaggcattcaaccgtgagaaagacacgattgaggaatttaaccgcaccaatgagattttatatcagtctgcatggaaatcacagtttttgtcaggtatgatgcagccgatcatgatgtttgtcggaaatctcggttacgcagcagtggctttatccggtggactgcttgcaatccgtggaacgatcacgatcggtgatatccaggcatttatccagtatgtaaaaaacttcacacagccgatccagcagattgcacaggtcatcaatcaggtacagtcgatggcggcagcatctgagcgtgtgtttgagtttttaaatgaggaagaggaagatcagaccgtagaacatccggcagatgtgagtgccgtaaccggaaccgtcgattttgatcatgtacagtttggttacaacccggatcagacgatcatcaaagatttcagtgcacatgtcaaaccggggcagaagattgcaatcgttggaccgaccggcgcaggaaagactacgatggtaaagcttctgatgcgtttttatgatgtaaacagcggttccattaaattagacggtcatgatgtcagggattttaaccgcagggaattaagagatgcgtttggaatggtattgcaggatacctggctgtttaagggaacgatcatggaaaatatccgttacggacgtttagaagctacagatgaagaggtcattgcagcggcgaaagcggcacatgctgaccatttcattaagacacttccgggtggttaccagatggaattaaatgaggatgcaagcaatgtttcacagggacagaagcagctccttacgatcgcaagggcaatccttgcggacaataagattttgatcctcgatgaggcaacatcttcggttgatacgagaaccgaggtcacaatccagaaagcgatggataatctgatgcgtggcagaaccagttttgtcattgcacacagactctcaacgatccgcaatgcggatctgatccttgtcatgaaggacggggatatcgtggagcagggaaatcatgaagaactgcttgaaaaaaatggattttatgcaaatctttataattcacagtttgaggatgttgttgcgtaagaggatatgggatgtcgtcgtttggcggcatccttttttcgtgcagattttgccgggtatggaattcattttcgttccggatacataaaagaaaaatagctgcataaattttccggcaaacaggaaacactatgagaaaaagccacattcatgcggcagaaagcaggaaaatcatatggacaaaatgaatatcagaaaagcggcaatgatcggctgcggattcgtgggcgcatcatcggcatttgcgctgatgcagagcggtattttttcggagatggtcatgattgatgcagatcacgcgaaggcggagggggaagcgatggatctaagccacggacttccatttgcaagaccggtaaaaatatatgccggggactatgatgacattgtagatgccggaattattatcatcacggcgggtgcaaaccagaagccggatgagacgcggcttgatctgatccacaaaaatgtggagatatacaaacagatcatcccggagatcgcaaagcgcggctgtgagggaatccttcttatcgtatccaatccggtcgatatccttacctacacagcactgaaactttccggtttcccggaacaccgcgtgatcggttccgggacagtgcttgataccgcccggttaaaatatctgatcggggagcatttaggggtagataaccgcagtgtgcatgcgtttatcatcggggaacacggagacagtgaacttgccgcatggtccaatgcgaatatttccggtgtccgtctgagtgatttttgcgaaatgcgtggtcattttatgcatgaggaatccgaaaaccgtatctatgaaaaagtaagaaacagcgcttacgagatcattgaacgcaagcatgcgacctattatgggattgcgatggcggtaaagcggatctgtgaatgtatcatccgaaatgaacagtcgatccttccggtatcttccatgatgcatggcatttacggaatgaaagatattgtgatcagcatgcctgccattgtcggaaaggacggtgtggagaacgtgataccgatctcactggacgaggaagaaaaaatgcagttgaaaagatcagcggatattttaaccgggatgaaagaaatgataaaaaaagaacacgggatcggttaaaaaaacaggatagttgtggtatagtttattagcagatgatgtaaaaaaaattgtatcaacaggaatacaaaggaggacacatcatgtccatgcgcatatataccatgacacacaaaaaatttacacccctgccggatccgctttatgtaccgcttcatgtcggaagggcatgcggggagaatctgggatatttgggggatgatacgggagaacagatctcagcgctgaactgttattacagtgagctgaccgggttttactggatctggaaaaactgccatgatgccgattatgtcggcacctgccattacagacggtatctgatcaacgaaaaagaacagatctatacggaggaggaataccgggaactgttaagaaaatacgatctggtcacgaccaaaaaagtccagttaaacaattcttattacgacggatttttggcaaaccacaatatacgggcactggagatgacaggaaaggtcattacagagaaatatccggaatatgcggatgcatttgaacagcttgtaaatggcagacagacttattttggaaatatccttgtcacttcaaaaatattatttgatgaatatgcatcctggctgttttccattttctttgaggtggcagagcggatcgaattagaaacgggggaagatgcctaccataaaagagtatttggatttatttccgaatttctcctgcttgtgtgggttacagtgaaaaagctgcgtgtatatgagtgcaaagtgggaatgcttggagaaaaggcagagaccggtgaattaaaaaggtgtcttgccgaatgtttcagaaaccgcgatgttgatctggcaaagaaaatttttttggagacaagagaaaaaagaccggatgtattaatggaggcatctgatatcacgggtgaattgcatctgtgcatgcagatcattgcaaccgcgggggaagaaagaaatcatggcgaaaccatgattttagaaagagaaaatgattttggcagactgatggagatattttcgaaattaaaccgggttgtgagccggtaccgcgaaaacagcgagagcgaagaggatatccgttttctgggcgaagggaaaatatcaaagaccgcagtgtgggtggcagtcatgatgggaaaagaatctgaaagtgagaaaaaagatctgatggatcgcatgttaaaatatcttcattaaattttaagaaatgccggaaagcaggaaaatacacgcatgaggaagaatgccgtaacctgcaccggcattttttgttgacaattattttatggtctgctatgataaaacgtgcgtaaaaaagtaacattttttttatgctgcagatcccttataatagtaagagcaggcaaccgtagtctaatggatagaacaccggactccgactccggcaatgcgggttcgattcccgccgggtgcattttgacagtcagatagcaggcggcatgttatatgttacgcctgttacatattttatggcgttttatacaacaaaaggaaagggatggaaaatacgatggcttcttcaaatgttgatgataaattaaaaaaagatacagaaaataaagagacaggcaataaagaaacaaataagattcttacatttataaaacagaatgtgcgttatattacagcaggggtattgttccttgcaatggtacttattttagtaaaggtcggatctccgaaacagccacagaatggacagaatgttgcggcaacagaggtagcttcagaggcatcagatgacgcaaaacaggagtttgaggtggatgcacatgaagatgtaaatacactgatcaaccagtactataccgcatatgcagcgggagacacggatacactttcaacaatcgcaaccccgctgtctgaaaatgaaaaaagttatatttccgtattcagtcagtatgtagatgcataccagaatatcaaatgctacacaaaacaggggcttgatgcatcttcttatcttgtatccgtttatgttgaagtgaaatttaaagatgtagatacggttgcgccgggactggatttcttctatgtgcgcacgaatgaagatggcagtgtatacattgataacctttacagccagtacaatttaaagattaaagaaaatgcgttagatacaagcattcagaacctgatcagtgagtacgaggacagcgaagatgtcaatacacttcagaaagaagtacagggtaaatatgacacggccattgcttcggatgataagttaagtgagatgatctccacgacgattccgaatgcgatcactgagtgggcaggcacgatcgtcagccagaataccgagacagagagcacagagcaggctccggaagaaacaacagaatcagagcagactgagacaccggaggagaatacggagcagccggcggaagatacaccgacacagggtgagccggataccgtttatgcagtagatactgtaaatgtcagagcagccgcagatacagaatccgataaaattggaacgttagagaaaggcacagcacttacaagaacaggtacagatggagagtggagtgttgtaaattataacggacagaccggatatattaagacagagtatcttacaacgaaaaattccgattctgattcagataacggtggaaatgaagagcagacgaccacaagcaattttatagctgagggaacagtcattacgctgagtgattccataaatatccgttcgggaatgagcgagaacgacagcaagatcggaacagctttttccggtgagaaggtcacggtagttatgagctatgcagagggatggacaaaggtaacctggaatggacagaccggttatattaagacttccctgttacagtaaatgttcaatatacaatggatggcacatttttagtaacagacttgtagccacagtagaaatggcggagactttaaagataagtctccgcttttgtgcagaaagagaaaggtgaaaaatgcaggagccagtcagaatcaataaatatctcagcgaggcaggcgtgtgctcaagaagagaggcggaccgtcaggtagaagcaggaaatgtgacgatagatggtgtggttgcttccatgggagcaaaagtattgccagaccagacggttcttttttgcggaaagccggtaaaaaaagaagaggaaatgatacttctggcatttcacaagccaaccggaattgtatgtaccgctgaaaagagggaaaagaataatgtcgtggattacatcaattatccgaaacggatttatccgattggaaggctggacaaagattccgaaggcttattgcttatgacaaacaatggtgacattgtaaaccgcatcatgcgtgccggaaatatgcatgaaaaagaatatatcgtcacggtcaacaagcccgtgaccgacagtttcctgcgtggacttgcaggaggagttccactggtggaattaaatgccacgacgcgcaaatgcaaagtatggaggatcgggaaaagacagtttggcattatactgacacagggattgaaccgtcagatccggcgcatgtgtgaatattttgggtacagagtggaaaaactggtaagaacccgtatcatgaatattgaactgggagatttaaaagccggaacttaccgcgaggtaactccgcaggaatataaagagttgatgaggctggtaaaagattcatcaaatacgacagtgattcacggacgggatggaggagacagatgacaccggaagaacagatcaaagagttaagggataagatcaattatcacagtgacagatattataatcaggacagtcctgagatctctgattatgaatttgacatgctgatgcagcagttgaaaaaattagaaaaagagcatccggaactggtgacaaaagattctccgacacagcatgtcggcggcacggcaaagcggactgccggagtcttagtgcatcacaatgtgccgatgttaagtcttcaggatgttttctcaaaagaagaggtcgttgattttgtagagcagatgaaagagcagcttgatgatccggagtttgtggtcgaatataagattgatgggctgtccatggcgctgcgttatgaaaatggcgatctttcacttgcattgacgcgcggtgatggtgtgaattttggcgaggatgtgaccgcgaacgcaaaagtgatctcagatgtcaaaaagaaattaaaggacaaaccggaatatttggagatccgtggggaagtctacatgaaaaatgaagattttgacagagtcaatgaacagcaggaactgcttggaaaaaagatttttgccaatccgagaaactgcgcagcaggaacgctgcgtcagcttgacagccgcgtgacaaaagagagaaaactttccatgtttgtatttaatatccagcaggtgcgtggcatggacattatgactcacacgcagggatatgaatttttaaagagacagggcatcccgatcatcgaagattacaaagtatgcaaaacagcggatgaagtctggaatgcaattacagcgatcggagaaaaccgtggaaatctcggctacgatatcgatggtgcggtcattaagatcaaccgctattcggacagggaactgctcggaaatacatcaaaagttccaaaatgggcaatcgcatacaaatatccgccggaagaaaaggaaacaaaactgcttgatattgaactttccgttggaaggaccggaaggatcacaccgactgccgtgtttgagccggtgcgcctgtgtggaacgtctgtttcaagggcaacactgcacaatcaggatttcattgatgatttagatgtcggcattggcgatacgatcgtggtttacaaatccggagagatcattccgaaagtaaaagaagtccgcaaagaaaaaaggacggagggctggaaacgctttgcaatcccggatgtctgccctgtctgcggtgcaaagacagaacgtgaaaaagatactgcggatatcaagtgtacttcaccaaattgtccggcacagttagaacgccatatcatcaattttgtcggcagggatgccatggatatcaagggatttggtacagtttatattgaagaacttgttcgtttggggtatattaaggatattgccgatatatttgaactgaaagatcacagggaagagttgatcgaacagggtattatcggaaaagaaaagaatacagacaagcttttagaaacaatcgaaaaggcaaaagaaaatgatgcatacatgcttctgaccggatttggtattccgaatgttggaaaagctgccgcaaagacgatcatgaaacgtttttcttcgatccttgatttagaggatgctgacagggatgccctgatggaggtggacgatgtcggggaagtcagcgcagactgcattttccgtttcttccatgatgaaaaaaataaagaaatgatcgcccgcctaaagtctttaggtgtgaacatggaagcggaagagaccgagacgatcgattcggcagtcagtggaaaaacagttgtcatcacaggtacactgccgacacttggaagaaaagaagcggcggaactggtggagaaatacggcggaaaagtatcaggatccgtatcgaaaaagacagattatgttgttgcaggagagagtgcgggcagcaaactgacaaaggcacaggaacttggaatcacggtgctcacggaagcagaactgtttgtactgcttggaatcagcgcagagaatggagaatagtgtggcaaataagctcgatagcttatttgccacacagatatttgtttctgagcaaaacaaatatcttttatggcagacagaaatttgaaatttccgtcgccgcttcgcaacaagttgctcagagaatggagaatgttatgccaattaaaacacagagtgatttaccggcgaaagagatattggagaaggaaaatatatttgttatggatgaaagtcgagcaacacatcaggatatccgcgttattgagattggaatcctgaatttaatgccgttaaaagaagacacagagctgcagctcttgcgttcgctgtcgaacacaccgctgcagatcaatgtgacatttatcacagtatcgtcccatgagtcaaaaaacacatccatgagccatttaaacaaattctacgagacgtttgatggagtaaaaaaccgttattttgacggactcatcatcacaggggctccggtggaacagatggaatttgaggaagtggactactggaaggaaatgtgtgatatttttgaatggacgaaaacacatgtgacatccacgatgcatttatgctggggtgcacaggcaggactttattatcattatggattgaaaaagcatctgctggacaaaaaggtattcggggtgtttgaacatcatgtcatgaaccgcaaagtgccgttagtccgcggctttgacgattattttatggcaccgcactccagacatacagaagtgagagcggaagatatccgtaaaataccggatctgacgattcttgccgagtctgatgaggcaggtgtgttccttgcaatcgcagacgaaggcagacgcattttcgtcatgggacacccggagtatgaccgtgtcacacttgacaaggagtacaaacgtgataaagaaaaaggactgccgatcgatctcccggtcaactattatccggatgatgatgatacgaaaaagccgaggctggagtggcggtcacatgggaatatcctctactcaaactggctgaactattatgtgtaccagacgacaccgtatgagttcattgatacggcggagattgtagggaaatagggacttagagctgtttttatagggtttgcgtaaaaatcaaaaattaatagtaagttgatatatcttcatataaattgatataattttgtatatctgtggagacaaaatggagacagctcaattttgatggagacaaaataatcaattatatttggagaaaagaatcttatgtaaaaaataatagtgcagtgcattatttatatttaggacatctaaataagtccatatacttgtatttattatgagtatgtgggcttattttagtgccttaaaacacaaatacacactaatggtcataaaatgcctgtatgagccacagagagcgtcagagagcctttatatgaccgaattaagaaatatgcatttcattagaaaaaatacaaggagcattcctgttaagtaacaaataaccggtttgcaaaaaatgagtgccacccatagaataatgattgttaacttggcggttaataagaatcattgttcaaaggagacacccacaaatgaattataagcagaatgaaaaaatcaatcaagtaaaagaatcaactttggtagttggaatcgatatcggaagcacgacacagtacgccagggcatttgactggagaggcattgagcttgggaaagtctttccgttcagcaacagcagagaaggatttgaatctttcaaagcatggatgcagcatttacaggacaagtataagaagctggatgcaatcgtaggtatcgagccgacaggtcattactggtttgaccttggcgcttatcttgaggatgagggcatcctcctggttatggttaacccttatgcggtaaagcagaccaaggaactggatgacaacagccaaagcaagaatgacaggaaggatccgaaggtgatcgcaaagctggttaccgagggccggtattctgcaccgtatacaccggatggtgtgtatgctgatttaagaattatggtggccaatcgtaagagactcatcagggagatgacccagatcaaaaacagatttgccagatggttcgccatatatttccccgagtacacagatgtgtttggggactatgaagcacagagcagtatgctgcttctaaagaaagtttgtactccggaagcaatcgtggaactgggagccgagaaaatcaatcaaatctggcgtgatgcaaagcttagggctgtgggaatgaaaagggcaacgaccctgtgtgagacagcaaaacgcagcatcggcttaaagaaaggctcttcggctgcccagtatgaaatgaaactgttgctcgaggattacgaatacaaaaaggcacagctggatgccgttatggaggaaatagaaaagctgtgcaggaagatacccgaaagcgagcagatgcttgccatcaaaggtataggagtaatcacggtagccggatttctggcagaagtgggtgatgtgaggcgtttcgaatcacccagacagatacaaaagctggcaggactctcattacgggagaacagctcaggaaagcacaaaggacagacgaccataagcaaaagaggtcggagtaagctgcgggcagtactgttcaatgcagcaattccgctgatagcgaagaacccagagtttaagtcattgcatgagtattacacgacaagagcgaacaatccactcaagaagaaacaatccgtgattgccatcagctgtaagctgatacgggtcttttatgccatcctggcaaaaggagtgacctatgatgcacagaagttgatttctgacattcacaggcagccgcaggtagcgtaagaagaccaactgtgagattcaggagacgtccgccgtaaggcgctgaaaggaacagaagaatttcataaacatagagagccaagtcagatttatttccatcagagcagagactcagcgaaggagcatcatgacgcccctttatggataagcagaacgaaggaattaaggacccagaagtaaaggagatcctgtatgacatgggaggttaggctgccgtaaggagttggggaaagaaaggccgatcatagcagaataagacgacgtcttattttgtgcaccctaaacatccgaatatccatgattcatggccaaggggaatgacatagacttagaaaatatctctatgaagaaatgaaaatgtgagaaaaagcgagttaacaagagaaaaacaaagattattatgggaggaattttaaatgtttggaaccaatgtcacttagttaagcttattggttcactatgaggcaagcaatttgatattaaatcagttggttatcccttggcaagtgctacaaagagaagaagccgttataaatcagcaaaggtttatgctatcggtgttgattatgacaaagcaagggataagttctttgcaaggatcacaccattcgggcatgacaaacaagttaagctgcattactggaatacggaagaagaagcttttcaagaatataaactatttaaggaatcggagattagggtattggcattgagatatagagataagataccagacaggctatttgatgcattgattaaatatgaggtgcatccttatagtccgtatgaagattgacgtttccaaagagggaaacgttgtaaaactgaattaaaccaatagtttaatgacagataatgcttataggcataaaattaaatataatttcgaggtgctgtcagataaaattactggaagaaacattgaaataatgataaaatatgtttgtgtatcgggatggaagatgtataaggaggagcaatgtgaagcctatatatttatcaatccaacaagaagcaacaggaaacagaatcagagaacttttattgaataatggatatacagtaaaagatattcaagaagttatgggatttgaaaatccacaggcagtctataaatggctttctggtaaatcgttacccaacttggataatctgctgattctaagcaaagtgttacataccagtatagaagatatcctcgtcattgacggggatattgctattttgatggagggtgctacacaatggataatgtatggaataaaacagatttttggtatgaaagaaaaagaccgtggaagatacctggtcttgtgttgcggaatataaaatacagctttcagagagtgacaaaaggttattgcgataaggatttatggaacattgattattggtttatgaatcttatgccagatatgttgcaacaattcaaagatacaaagcatggaagtccgagctgtttggggacagagtacgtggatgaacatgggatttcctgcaatgatgaatgtcatgcagagtgggataaaattttggataagatgatattcttatttagagaaatgaatgaggaaatgtgccagaagaaaaatacatatcagaaaaagcatgagggtgtattacaagagtttgaagcaaaatatggaatctttggacaaaaactcgaagaagaaaagaaaaataaacatagtagagttttgcattttcctagtgaaataccagagtataaggatattgaggaaaaatattatgaggaagaaaaagcattgagccagtacagggaagattgcaagaatgaggcattggaattattttctaagtggttctattcgttgtgggattagagattagggcatattggatattagtttatctgatatgccctatttttttaccttttttgtaggtggatatggtaaaatggagcatataattaataatgttgggagaagtaaaaatgagtgttatatttggatatgttatggataagaaggtttatttagcagcggacaatagaataacagatgcagagggtaaattcatatcggatgatgatataaaaatagaagtggttaataataatacatctgtagcttttgctggaaactatggagcacaatctttttttatgaagtgctataaaggtatgcaaggttatcaaaattggtttgttaatgatcttgcaagtaatatatattcgatgtgtaatgcaattatcaatatggatactgaatgggcaaaactaatagcaaatagtaatgcttgttttttggttgcaggaagaactgtagataggaaagcaaaattatttgcagttacattgaggaaaaaacatatagatttaaagccagtttcaatgatgttatttcatcctaatgattgtgactttcaaacatgtgcaaatattttatgcaaaaacataaaacaatatcctgatgatttttcaaaatatacaatacaagagatttcaaaaataagtaatttagtaagtgattctgggaatgtgtggatgtttgatacaaaaaatgatgaaagtacatttgttgctttgtaatttattataatggttggtctgtatcagatggaatatatctgacaatatcgcaaatattacaatcaagaatcctgcataaatcattaagtgtttttgttgatacatctttattatgttttaatcggtggagtgtgctatgtgacatatgatgtttgtttgtaagtgtgtaccagttttcgcttgaattttcaagtgtattccaaaatggggaatagtcaatcatcatagcacctccgtttcgttagtatatgaaacaagtgtactttgtattctttgaattgaatatcttcgttaaaagggatataatagagttattaggattggaggtagaaggtatggcagatatatgtacttgttgcggaaagaagataccattccttgatattgattatgacttaataaaaattggtaacgaggaatataggttatctgatgctgaaatactagaaaaatactctgattatagaaaaagaattgagaaacaaactggtagacaaatgacggattttgaatttttgtctggtatcatggaagctagaagagatagtttaaatcatcaagcagaaacatattttgcaagcaacaaagaagcaaatgttaataaaccgaaatgtcctacgtgtcaaagtgaaaatattcaaaaaatttctgctatgacaaaagcaggaagtgtagcattatggggtatattttcgcagaaggttaagaagcaatggcattgtaattcttgtgggagtgaatggtaaaggagaaaaaaattatatatgaagaataagaagataatttttgcttttatggcagctattattctgatcttacttatctgtattccacttgtaattaagataaacaaaaatgtaaaattccagagtaaagaggaaatgtcagaagtaatagatggcacatggaaaactggtgatggggattatgattttatatttaccgttgacaacgatagtgcttatttgagcaatggtgataaatcagataatccatctaaaatagtcttagttccagacaaaggatatttctattatgaaaagaatggagatacaaagaaatccagatataatgtggtctatgaagacggacagtatatgataaaggatgatcattggacattcaaaaaataattttctgaaattttagggtacgactgctgctgtatggtacttaatatagcgtggtttttatgtgccccggtggagggagagtgaagcggatgaataaaaagataaatgcaatatttactggacttgggttagtatcacagatattttatttgtggaatgcttttaatatatggtttagacatattggcatcagtttgtcacaaatttatgattcgttatttaaaatcttagttgttgtagttggatttgttcttgtgattataagcatgatattccatagggacaattataagattgtgaatatttttaattatattgccgtggttctgttagttgtttctacagggttattggtaatgccgtggtgatgaaaggagttagcatgaaaaagaaaatattacatatcattgtaccgattttgcttacagtagtagcatattttgtttgtacaaaagcattttatattccagatccgacaaagcctaacacagccacatgggtaacagatgcaatatcaataggtgtgtctatatttactttgggagtatcagcgattatatctgcaatattgtatgtcggaagtaaaaagaaataggaaagctggtgatttagttatgaaaaagaattttgatgttttgaaaaagcagacaagattttatatattgctgattgcattagttgttgtcttagttggattgattttcaaagggatttattcgattcaatataacaatacatatacagaaatgtgtaatgaatcagaatatacatttacagatataaatggcaaggtgcaagtaaaaacaatatatcctcatcaagtagaagcaagaatgaaagaaaataatcaaggctttataatggaattaaaaggtattggttatctgatgatggtaataggtggatttgccattttattttctggtatgacttgtggttggactatgttaccagaaaaatataaagctggcaaggatgatgcagatatatccaatataagaacagcagtagaatgtccatattgtcattcgaccaatactaagaaaataagcacagcaaatagaatggtatagcttcaagctcgtcaatggtgagctcaagagccttatatcgactcatgatcaagttaagagtgcttgatccgattcgaaaacgatccataacagatctggttgggcacttattcagacgcatctgaatagcaccaataatagtgttgtagtcctgcataaaaatgcctcctttcgtaatctaaaaataatgactacgaaaaaactataacactttataagaatgcgtgatccgacgaagcggaaaagtgttccgttacaaccggaaacactgatccgttgctagcggaatcggtgatctgatgaagcggaatttgcagtttcttgattggatcaagcatatgaatggttttatgttaatggcatatctgataatagtaaggtatatgcgtatctattgatgacgaatacatttcttaatgatgatgagaatgtaacaactgacaatccgtatacagtaaaagcagaaaaaacgtggtatgcatatgcttttgcaggtaaaaatgatttatttttactatcaatttagaaattttatggacagttgatattgtaggcaaataacttcttgtaatctatcttcttttgtagtattgttatgacaagggggtgcacaaaagatgccaatggtaaagaatgttgaaaagaaaatatgggacgtagaaaaatttgaagtcataatgcgttctagtgatggaaaagatttaagaggaaataagaaagatatgcctcagtattctttttcaaaaaaggcttctggagatatgaccgttagtcaatggaaacaaaatagattttatccgtactatcctggattagaagtagatgtgttagatgttgttggaatagcagtatctggacagacaaagtttaaaaatgtaagaaatacttataaggacgagtaaaagcaaagggctgtaaaatgattctatgataaagaaacgctagattcggtggatgtcgattctggcgtttcttcactttaatcttcttgtttaaaaaaataactacttttgcatagaaactgttaatgatatataaggcgctttaaaaatttgctggctagtacaattcagggaatgttagaagccgaaatggacgatcagttaggttatgataagtattaacgttcacatgagccatactatcgaaatgactcaaagtcaaaaactgtgcaaagccaatattatcttcctatgaaaaagactttgaattaacttttacacataattccacagctatagaaggtaatacattgacgctgatggaaaccaaggtagtactggaagatggaatatctgtaggcggaaaagaactgcgtgaaatatatgaagttgtcaatcacaagaaggcgtatcagtatgttaaaaagtgcattgcggaaggaaaaatactggatgaacctattgtaaaggatattcatgcaattttgacagaaaatattatagttggtggtatttaccggaatcaggaagtacggatcagtggtgcggggcatgttccgccagttgggaatggccggtatctatcgcaaaagaaaatcgactggattattacaatgccctggaaacctatgcggtacgaggagagctcggagaatttgcagatttagtggcagaattgtaagaacagcagttagatgtctatatcaaactgatttaaagataaagatactaccattctgacagataatcccggttttatacaaattttagtttccaaaacaagaatagtctgttataataagtttataatatcacttaggaggcaattagcgatgggtgaggatagaaaaacatttaaaataaaggatggtaatttgggagaagtgaagatagcagatgaagtagttgccatcattgcagggcttgccgctacagaggttgaaggggtaggttccatggctggcaacattacaaatgaacttgttagtaagcttggcatgaagaatctttccaaaggcattcgagtagaggtgcttgagggaaccgtcaatgtggacgttgcgctgaatatctcttatggttattccattccggaggtatctgccaaagtacaggacagagtaaaaaatgcgattgaaaatatgacaggacttgaagtatccgtagtgaacatccgtatcgcaagtgtggacatgggcaacaataaataatgctattctaagaaaagagggtgtcttaagcgacatcctttttccttatgcgtaaaagaatacaagaagaaaggatgacagaagaaaagaatatgaccagaagagagataagagagcaggtatttaaaatgctgttccgtgtggaattttataatcaggaagagatgtcagagcagattgcattgtgtgaggatgatgcctgcagctggaaagaaaaagacaagacatatatttttgaaaaagtagaaaagatttctgaaaagattgaggagatcgacgcgaagatcaatgaggtatcagaaggctggaaaacaggaagaatgggaaaagttgatctgacattgatccgtctggcagtgtatgaaatgctgtatgaggaagatgtaccggcgaaagttgcaatcaacgaggcggtggaacttgcaaaacagtacggcacggacaattcaccttcatttgtaaatggcgtactggcaaaactggtatgatgaaaaacgtatattccgtagggcaggtcaatacatatatcaaaaatatgtttgcccaggattttatgttacagcggatcagtgtaaagggagaagtgtctaactgcaaatatcatacgtccggtcatatctattttacgatcaaggatgcagccgggacgcttaacgcagtgatgtttgcgggcagcagaaaaggtctgaagttccagatgaaagaaggcgaccaggttgtcgtgacgggttcggtggaagtatacgagcgtgatggaaagtatcagatctatgcaagagaaatcgaacttgacggtgcgggaaacctttaccagaagtttgaagctctgaaacaggaattagaagaaatgggaatgtttgcggcagaatacaaacagccgatcccgccgtatgcaatgaagatcggagttgtgacagcaccgaccggtgctgcggtgcaggatatccgcaatatttctgcgagacgtaacccgtttgtgcagctgattttataccctgctttagtgcagggggatggtgctgtagagagtattgtaaatggaatccatgcgttagatgcgcttggggtggatgtcatgattgtcggcaggggcggtggttcgattgaagatctgtgggcgttcaatgaggaagaggtagcgcgagccatttttgagtgtgaaactccggttatttcagcagtcggtcatgaaacagactggacgatcgctgattttgtggcagatctgcgggcaccgacgccgtcggcagcagcagaacttgcagtgtttgattatgcggcagtggagggaagacttggcgagatcaaagagcggatgttcttattgaatatgcagcgcatccagcagatgcgaaaagaattagaacatgcaaaggacagactttcctatctgagccctgaggggcagttgcgcgaaaaaagaaaatatgcggcagatctggaagaacagctaagaaaccgcatggagcatatgattgagctgcgcaggcataagctggcgctgctttcggaaagattagagggtgtgtcgccggtaaaaaaacttgcacagggatattcttatgtgacagatgaaaacgggcatacacttacagatgcagagggtgtgaaagcgggtgaccgtgtgaaaatccgcctgttaaaaggtgcgttagaggcagaggtgacggaggttttacatgagcgatgaaacaaaaaacaagcctgcgctggaagataattttgcagagcttgaggatattttaaaacagatggaacagccggagatttcactggaacagtcatttttgctgtatcagagcggtgtggaaaaactaaaagagtgcaatgtgatgttagataccgtagagaaaaagatgcagattttaaatgccaaaggggaactggaagatttttaagatgcagacggtgcatatggaggagcagatatggatatcaaagcggaaataggcagacatacagatgaggcagaacagatcataacttcctatctgccagaggaaaagggataccagaaaactgtgatcgaagcaatgaattacagttttcttgcaggaggaaaaagattacggccgattcttatgttagagacttaccggctgtttggcggaaaatcgaaagtaatcgagccgtttatggctgcaatcgagatgatacatacatattcactggtgcatgatgatcttccggcgatggacaatgatgaataccgccgtggcaaaaagacaacacacgtggtgtatggggaggcaatggcgatccttgccggggatgctcttttgacatatgcatttgagacggcggcgaaggcactggatatcgaaccacagaatccgggaattggaaaagcaatccgtattttgtctgcaaaagcgggaatttatggaatggtcggcggacagacagtggatgttgagtctgagaatacctgtgatatgacaaaagaaaaacttgattttatctatcgtctcaagacaagtgcgctgatcgaggcgtccatgatgattggatctgttcttgctggggcgaccggaagtgaacagaagatcgtggaagcggtggcatcaaaagtcggccttgcattccagatacaggatgatatcctcgatgtgacaagtacgatggaagtgcttggaaagccgatcggcagtgatgagaagaatcacaagagcacctatgtgacgtatgaaggaatcgagaaggcaaaacaggatgttgcagacctttcggaaaaggcgatcgcacagatggagacactggttgtgaaaaatgaattcctgacagaattattgcgctatctgatttcgcgtgaaaaataattcgccgttcgtcaatcatgcgagcatgttgactctcttgcgctcattatatcctgtgcaaaaacagcgcatgatccaattcgccgttcgtcaattatgcaggcatattgactctcttgcgctcattatatcctgaataaatcggtacaaaaagagaaccgggaaacagaggaagtcagtatgatattggaaaaaataaaaaaagaaaatgatatcaaagaactctcagaggaagagttagagatattagcggatgagatccgtgaatttttaattcagaaaatatcggttaccggtggacacctggcgtcaaatctgggtgtggtggagcttaccatggcgcttcatctgtttttggatctgccaaaggacaaactgatctgggatgttggtcatcagtcctacacacataaactgttaaccggaagaagagaaaactttgatacactccgcaaatatggcgggatgagcggttttccgaaacgaaaagaaagcgactgtgactgctttgatacgggacacagttccacctcgatttctgccggattaggctatgcacatgccagagagatcgcgggcgaggattataaggtcgtatctgtgatcggggacggtgcgctgactggcggcatggcatttgaagctctgaataatgcggcacagttaaaatctaattttattattgtgctgaatgataacaatatgtctatttctgaaaatgtcggtggactctcgacatatttgtcaggttttcggacggcagatgcctatctggatctgaaaatgggcgtaatgaattcgctaaataagattccggtttacggcaataaaatggtagagcggatccgtaagacgaagagtggaatcaaacagctgtttattccgggtatgctttttgaagagatgggcatcatttatttaggaccggttgatggcagtgatatgaagggaatcttaagactgctgaaagaagcgtcgaatattgaaggcccggtcatggtacatgttttaacacacaaaggtgcaggatatctgcctgccgagcgccatccggcaagatttcatggtacggagccgtttgatattgagaccggattgccaagcaaaccgagagtgaaagcaaactacacggatattttttcaactgtgatgcgcaagcttggtgaccgtgatgaaaaagtggtagcgatcacagcggctatgacggacggcacgggactcaaacgttttcataatatgttcccggatcgtttctttgatgttggtattgcggaggaacatgcagttacgtttgcggcaggacttgcggcggcagggttaaaaccgatatttgcggtatattcatctttcctgcagcgtgcatatgaccagatcctgcatgatgtgtgtattcagaatctgccggttgtttttgcaatcgacagggcaggacttgtcggcagtgacggagagacacaccagggtattttcgatatatcctatctgtctgcgattccgaacatgacgatcatggcaccgaaaaataaatgggaactttccgatatgatcaagtatgccgtcgattttccgacaccgatcgcagtgcggtatccgcgtggggaagcgtatgacgggttgaaagaatacaggcagccgatttccgccggcaagagtgaatggatctatcgtgaatcagagattgcactggttgcgttaggatcgatggttaagacggctgaaaaagtgcatgcggcattaagggaagaaggcattcctgcaagtcttatcaattcccgttttgcaaagccgttagacacacagatgttaatggaggctgcatcgaaacatacactggtcgttaccatggaagagaatgtcataaatggtggcttcggggagcatatcacccgtttttataacgaacagggaatctatgtgaatgtacttaatatagcaatccctgatgagtatgtggagcatggaaatgtggatattctataccacgaagtcggtattgatgcggataccatattaaaacggatcaaagaggtttatcatccattataaggcagaaaggatacagattcattgaaagaaagattggatttattgttggtaaacagaggactggcaccgtccagggaaaaagcaaagacgatgatcatggaaggcaatgtgttcgtggaaaatgagcgcgaggacaaggcaggttccatgtttgatacagaggcaaagatcgagataaaaggaaatacgctgaaatatgtaagcagaggcggattgaagcttgaaaaagcgatgacacatttcgatatagaattaaatgacaaagtctgtatggatatcggggcgtcgaccggaggatttacagactgcatgctccagaacaacgcaaaaaaagtgtattctgtcgatgtcggatacggtcagtttgcatggaaactaagacaggatccgcgggtggtctgcatggaaaagacgaacatccgttatgtgacaccacaggatatcgatgatgtattagattttgcatctgttgacgtttcatttatctcattgacgaaggtgctaggcccggcaagagaactgttggcagatggcggcgaaatggtctgcctgatcaagccacagtttgaggcgggaagagaaaaagtaggaaaaaaaggtgttgtgcgcgataaatccgtacatgaggaagtaattgataaggtcatatcattcgcactttcaatcggattttctgtgcttcatctggaatattcgccgatcaagggacctgagggcaatattgagtatctggtgcatctgaaaaaagaggcagaggcagaacaggcaggcgtggaagaatctgtcgatgtacaaaaagtggtagatgcggcacatggagaactggacaaataaatgaaaaattttctgattatcacaaactattataaggattctgaggcgaggctgaccaatcgcattaaagaatacattgagaaaaagggtggttcctgcagcacttttttcagtaacggggagacaccgggtgaggcggcaccgcacagggaggatattcctgaaaatacacagggagttttggtgctcggtggagacggtacgctgatccgtgcagcagcagctttggtaaagagcagactgccgctgatcggtgtcaatttagggacactgggatatctgtgtgagctggaagaaaaagacgtatttgcggcagttgacaagctcatgaaagacgactacatggtcgaagagcggatgatgcttggcggatacgggatcaagggtggtgagatactgcctgcggatatcgcactcaatgatgtggtaattcacagaaccggggcactttcggtggtaaatctgatcgtctatgtcaatggtgaatatctgaatacgttccgcgcagatggaatcattatatcgacaccaaccggatctacaggatataatatgtcggcgggaggtccgatcgtggacccgaaggcacagatgatgctgatcacgccgatcaatgatcataacttaagctcaaaaagtatcgtgatcagtgcagatgaggaggttaccgtagaacttggaaagcgtcgctcccagaaagacgagatggtggaagtcagttttgacggagacagcaaagttcgtttggaagtgggcgatcgttttgtggtgcgcagggcggaagatacggcaaagatctgtaaattgagcagtgaaagtttccttgaaatattgcgcaggaagatgagcgcttatacataatagtggatttatctttagaacaggagaaagtatgaaaacaaagagacaggcaaaaatacttgaactgataaaaaagaataacatcgaaacacaggaagaattatcggattatttagagagggaaggatatcaggtaacgcaggcaacggtttcgagggatattcgggaattgaagctgacaaaggtggcagtcaacgggggcaggcagaaatatgttgcactgatggaggcaagcgaagatctgtctgaaaaatataccagagtgttccgcgatggatttgtttccatggatatggcacagaatatccttgttatcaagacggtatcaggaatggcaatggcggtggctgcggcacttgatgccatgcatctgcatgaagttgtgggatgtattgccggggatgatacgatcatgtgtgcagtcagaagtgtacaggaaactgttgaagttatgggacggctgcgcaaaattgtagaagaataacagactgtcagaaaagaggagatacttccgggagagaatgcgcgggaatgcgcaggaaggagattctatgttacaaaatctgcatgtgaaaaatttagcactgattgatgagtcggaggtcgattttgccgggggattaaatatcctgtccggtgagacaggtgccggaaagtccattatcattggatcaatcaatcttgcacttggaggcaaggttcagaaagaaatgctgcgtgacccggaaaaaccagcgctggtggaactcattttttctgttaccgaaaagcagaaacaggtgttaaagcagcttgatgtggagactgaggatgatgaggtcatcttaagccgcaggatcacgggtggacgcggtgtctcgaaggtcaatggcgagagtgtgcctgcttcaaaagtaaaagaaattgcttcggttttgattgacattcacggacaacatgagcatcagtcacttttgtcgaagaaaaagcatttagagatccttgacagttatgcaaaggaagagatcgagcagccgaaaaaggagcttgcagaggcatataaggactataagaaacttgtgtcagagttaaacgatgcggacgtggatgaggaagaacgcttaagggaagtttcgtttttggaatatgaagtcggtgagattgaagaggccggacttactgtgggagaagatgaggaattagagacacagtataagcgtttcatcaatgggaaaaaaattgtggaagcactcaatcaggcgtatcagtataccggagggatggatcaggcatcagagctgaccggacgtgcgctaagggaactttcaggcgtatcagtgtatgatgagaaaattgctgatatggaagaaacgcttacgcagatcgacaatctgctcaatgactttaaccgggagattgcagattatctggatgatacagattttgacgaggagacattttaccatctggaaaaacgtctggatgagatcaatcacttaaagtcaaaatatggaagttctattgaggaaatattaagtgcatgcgaagcgaaacaggaacggctgctccggttaaaagattatgatacttatctggctgatttaaaagaaaaagtaaaaaacgcggagaaaaaactgcagaaaagctgtgaaaaagtgtccgatatccgcaaaaaatatgcagaaaaactggttattgcagtgacggaagcattgaaagatctgaactttttagacgttgtatttgaaatgcggtttgacgtgctgtcaaattacacagcaaacggatacgacgatgcggagtttatgatctcgacgaatccgggagagccggtacgcccgcttggaaaggtggcatccgggggagaactttcaagaattatgcttgcgataaaaacagtgcttgccgatcaggacgaggtggagacgctgatctttgatgagatcgacagtggaatcagcggacgcacggcacagatggtttccgagaaaatgaatcttttaggacgtacacaccagatcatctgtatcacacatctgccgcagatcgctgcgatggcggatgcacattatctgattgagaaggctgtctcaaacggcgcaaccgtctcaaagatcagacggcttgatacggcagaaaccgtggacgaactgtcccgtatgcttggcggtgttgaaatcacggataaggtaagagaaagtgcgcgggaaatgaaagaacttgccgcaaaaaagaaaaaataaaaattccaaaaaaaggccggtgtgtcaggaagtggcagggcagtttggataaataacagcgtgaaaaagaaaaaagcacatataataaaaaggggatatcgaaacaggatatcttctttttttgcgaaagatggggaaaacaggagagagagaatgaaaaagataagtgcttattacagaattatacaaaatcttacctgtatgggattcttttttacgttgatttttgcggtaaaatcgtttgagaatgctgtgccggatgagatatatgtgagagcgggagaaacggtatcttatgattttgatgttccggtcagtgttgtgctaaagcaggacagtacggaggtatttgaatatctgacaaaagattcaccgcttacgtattgtgtaaattgcagattatttggaatttttcccgttaaagatatcacggttatgctggtggaaccggaaacggtttatgccagtggaatgccggttggaatttatgcgaaaacaaaaggagtacttgtgatcgggaatggggaagtggagagggtagatggacgggaggtaaagccgtcagaaaatcttgtaaaaagcggagattatattgtcagtgtcaatgggatggcagtcagcgagaaagaagaccttgctgcagcagtgaacgaagccggaggaggaaaagatattcttggaatcatgcgtggcgaggaatatattgaggtttccctggatccggtaaagagtgtcagtggaaaatatatgcttggtgtctgggtgagggacgaccttgcgggagtaggaacacttacttattacaaagcagatggaacctatgcagcacttggacatgcagtgagtgacagcgataccggaacaatcatgagtatagcggaagggtatctttatcatacagatattgtaggcataaagaaaggaaagtcaggcactccgggagaactttccggtattattcaatacggagacagtacaagaataggttcgatcatgcaaaacaccggtcttgggattcatggagtcttaaacggaaacttaaagtggttagaaaccggggagtgttatgaggtgcgttataaacaggatatcaggaccggaagtgcgtttattgtatcgtctgtttccggggagagtaaaaaatatgaagtgatggtggaaagtgttgattacagcggaaaagaggaaaataaaggaatcctgatccgggttacagaccctgaacttttagcgctgacaggcgggatcgtacagggaatgagcggcagtccgatcatacaggacgggaaactgatcggggccgttacacatgtgctcgtcaatgatccgaccaggggttatgggatattcattgagaaaatgctttaacatcacaggcaaatatggtattatgaaacaaaaagtgacagtttttgtaaatgggtggcatatgcatacagagagtgaaatagagaaattagcggcggaatatatggaggaaggccggacagcctttttttcaaaagaattaaataaggcgtcaactttaacgcagaatgcaatcgatatctatcggatggaaaaaaattatgaacagtatgcatttgcgcagaatatgatgggtgtcatctatgtgtcgcttggaaatgaatcggctgcaatggattgttatttagaagtgttagagtgttcaaaaagacatggaataacatccgttctggcattggcgtataataacataggttccagatatcaggagttacggcagcaccaaaaggcgattggatattttgaaaggtctgcagatgaacttgaaaaagtgacagacacagagaatgagaattttcagatcaggtatctgattacacacatgaatctcatgaagtcctatggggaacttgaccggcttgacgatgcacgcaaggaacttcttaaattagaaaaatgcagccagggtattgtgaatgaaatgtatcgttactcttatctgacattgaaatcaagactttactggaacattggggaaaaagaatatgtgtatgagcatttggatgaattgataaagggtggaattgatgattcaaatgcagcagattatattgaagatgtaagtgacttgtgcggcctgctgaaagatatgcaggagtttgacaagtggaaaagagtgattctggcatttgagcagcatgcaaagaaacagaacagcatttattatgaaatgattctcaatgaaatgtggctggattactataaggagcttggggacaacgagcagtatgtaaagctctgcattcactatgtagatgtggctcagcagcagaaaaaagcagacaatgaggaacgtgcatgtgcgatcgacttaaagattgaacttcaggaaaaggaagaacaacgcagacatgcggagatacgttccaatcaggatgcactgacaggtctgggcaaccgttatatgttagagaaggatgctgtggatgtgattgaacatgcaataaaaacaggcgaaaagattgctgtcggagtgcttgatatcgactgctttaaacagcataatgatacatatgggcatattcagggggatcgttgtcttcgacatgttgctgatgttttgaagaatgccgtggaaaaacgtggaaaggcatacaggtttggcggggatgagtttgtactgcttatccagaacggggaagaaaatacgatcacttccattgcagaaacgataaaaaaagaactgcagcagctgcatatagaggataaggattctggcagacaggcagccgtcacgatttcacagggatatgcgagtttcctgccaagcagacaggaaagcagaaatagtctgattgaacatgcggataaagcattgtatgaagtaaaagaaaacggaagggatggatttcgtattattgtagaataatccataatttatgtaaatttttgcgcttgacgactacattcgacaaaataatttgagtgaaaataagtatcatcaatttacaaataatttatgataatagaaagttcgcgaggcgcactttctattgttttgtcacaggagggcttgaaatggaaaaattaagtgtagcaattgctgatgataatgagataatgttacagttattaggggatattatcgaaagtgatgatgagttgaatgtggtaggaacagcaaaagacggtgaggaagcttatcgtgtgataaaaacaaaagagccggatatcgtgctgcttgacatagtaatgccaaagttagatggacttggggtacttagccgtgtgaacaaggataaaacgatcaaaaaacacccggcatttatcatgatcagtgcaatcggacaagatcgtatcacggaagatgcgatcaacatgggggcatcgtattacattatgaaaccatttgataatgatatgatcattgaccggatcaaacggatcaaaaaccgcagtgtgcccggaatggaaaaacgtaagataaatgcatatgaaaaggcagagccggtcagcgagcgcagtcttgaagcggatgtgacggagatcatccatgagatcggtgttccggcacatatcaaaggatatcagtacttaagggatgccattgttatgtccgtgaatgatatggagatgttaaattccatcacaaagatcctatacccgacgattgcaaagaaataccagacaacatcaagcagagtggagagagcgatccgtcacgcgatcgaggtagcatggagcaggggaaagatggatacgatcgatgagatgttcggttatacgatccacaatggaaaaggaaagccgaccaactcagaatttatcgcgctgatcacagaccgtattcgtctggaacataaaatgtattaatacttttcagaaaagtaaaaaagagttataatattctttagattttcaaaagtttatagaagaataaatttttggggctggagggtttatgacatgaaaaaaatattatttgcggcttcagaagctgtgccttttatgaaaaccggaggacttgcagatgtaacaggctcattgccaaaatattttgacaagaagaattatgatgtgagggtcattcttccaaaatatgtctgcatggaagaacggtggaaaggacagcttcattttttatgccatttttatgtgaatttaagctggaggaaacaatacgttgggatttttgaaacaacgtatgatggaattacttactatctggtcgacaatgaattttattttgcgggaaatgcaccgtacaacaatatttatgaggacgtggagaagttcgcattcttttcaaaagcagtgttagaggcattgccgtatcttgatttctgcccggatatcatccactgtcatgactggcagacgggactgcttccggtatttttgcgtactttatatggagatgaggaatactatacgggtataaagacggtattttccatccataatctgaaatttcagggaagatggaaactgcctgcagttatggatattaccggactgccggaacagatttttacctcagataagttagagtcttacggtgaggcgaattacttaaaaggcggtgtggtctatgcagatgcagtcaccacagtcagtccgacttatgcctatgagatcacgacaccagagggcggtgaaggattagaaggacttatgtatgcgtgcagggataaactttccggtattttaaatggcctggattatacagaatatgatccacagaaagatgtctatctgaccaatcattataacgaggtggattatagggaaggaaaggcactcaacaaaacacgtctgcaaaaaaatgtgtctcttccggtagacggggacgtatttctgatcggtatggtatcgcgtatgacagaccagaaagggtttgatctgatcgcatatatcatggatgaactgctcagtaccgagcgtgtccagtttgttgtggcaggaaccggagaggcacgatatcaggatatgctgtcttactttgcgggaaaatatccggataagatgaaggtacatatcggctattcagaggaacttgcccatcagatttatgcctcctgtgatgcatttttgatgccgtctttgtttgagccttgtggtttaagccagctgatgagccttcgttatggcacggttccgatcgtgcgtgaaacgggtggtcttaaggataccgtcattccgtataatgaatatacgaaagagggaaccggattctcctttgcaaattataatgcgcatgagatgttagcgacgatccgttatgcgttatccgtattttaccagcataaaaatgactgggatatactgataaaacacggtatgagtcaggatttctcctggaacgcatcggtggcagaatatgaaaagttgtacgacagtctgatgacaaagtttacatggtaatacggtcacttttttgaaaaataatttacatggtaatacggctgctttcccttgaataataatatacatggtcggagagaatatcctctgtggaaagctgtgtggcattgacttcctgaaccatttccgagagttcccgataggactgctgacgggtatctgcgggactgtttgcggaggatagcagaggatcggccggtgtggcaaaagaattgacgggaatgatgagaacttcgtggatgctgcttggaaggatataaagatcacttcttaagtgctctgcgaagttttttagcagatcctgatacaggatacatgcagagccgtttaattttgtatgattggacagcacatacatcggaaaaggtgccggtggagcaaggatggcggagctgtcgtcatcggaaagaagttcttttagcacgtcgctcatattgcgaagctcataatgctggagatccggtgtgtttttgcatgcaagtgcatacaggtcatcttttgtgatattccagaaggaaagatgatggttatggatcaggatcgtggcagagctgccagaggctgacggagagcaggaaatcttttcttctgaaaatgactggctgatatcgtccggatcaatgccgatcagacagttgaatacgatcgccaaatcaagaaaacgaaaatggggaacatctgttaacagcgccttgttgcgctcgtaattgatcagcttaaagataatgcgggactgaaccttctcatagcatgtgaaaaaggaaatatcaatactgtgggcgggtttgttctgctgataaatgtccctgatctcggtgcagatatcagaaatgggccggccgttttcatatgcatgaaaatagtcattcagataaatggtcggtgagatattgcagcccggagttaaaacggtcagaccgtctaagtgggtattgttattttttaaaatgtcctgtaggataatggaaacgtcagaaccaaatgcgtcctgtaaagattgtctgatctgctgtttaaatgtctgatatgtcataaagacctcctgtaaatacgaatctatccacgataaatccgcggtgcaggagaagatattactgtttctaaaatggggaaagtccacgcaaaacactgcgtggacttactataacacatgcatactacaaatgcaagaaaaattattcggattttaattttttccagagatagctgtaaagcgaagttgtggattcatcaaactgtttgtacacggtacagttatccagtgtttcctgtggcgggaaaatggtggtatcactcagagtctcatcgtcaagtgcatcaatcacagcaaggtttggtgtggcatagcagacataatcaaaatttttcatggcaacgtcctcacggcataggaaatcgagaaatttttcagcattttcctgatttttacagctctttggaatgaaccaggaatcgatccagaggttggaaccttcttttggaaccgtataggagaggtcatcatttaattccatcgcagtggctgcttccccggaataaactaatgccattgccgcatttccggcagccatttcatcggaagtctcatccacataataggcgtacacaagaggtttttgtttgatcagaagatcaacggcattattcagctcggtctcgttttctgtattgatgtcataatttaacaggcgaagagccgggacaaacgaatcacggacagaattctgcataatgatggaatctttgtagtgttcatcccacaggatattccaggaggacacctcatcatctgtgaccatcgtggtattgtagaggatgccgagcgttccgtaaaaatagggcatggagtaagaggcatccgggtcaaagatccttgccgcatcgatgatcgacggatcaatattttggtaattcgaaaaactgctgaagtcgatcttatttacttcgccctccgagatcagacgttctaccatatagtcggaagtgcagattaagtcataaccgatcgaaccggctttatatttcgtatacatttcctccgggctttcatattcttctaatttaacatggatgccggtttcctgttcaaacagttttaaaacagaactgtccatatattttccataatttaaaacgaccagcgaattatcgtcagcggtattttttgttccacagcctgcggcaaaaaaagcgccgagaagtaaaagcggaaaaacaatatattttttcatgatatcctcacgatctgccggataatacggcgtatctgtaattactggctgttcttagacgatctgcggttcatgacaagcaacagcagaaatgcggcaaaaaacagcagtgtggaaagtgcataaagctccggacgtacaccttttcgaagttctgtgtagagcatggtcgaaagtgtgttcacaccggcacccttggtaaaaaaggtgatggaaaaatcatccagggacatggtgacagccattaagaatccggaaaacacaccggatttgatatccggccaggtcactttataaaaggcataaagcggggaggcaccaagatctaaggccgcttcataggtgttccggtttacctgctttaattttggaagtacatttaaaatcacatacgggatatcaaatgtaatgtgtgcaatgagcaccgttacaaagcccagatttaaaaattttacaaaaagcagcatgagtgatattccggtcacgatatccgcgtttaacagcgggatgttggttgcaccgagcatcagtgtggtgccacgttttttcatcgcactgatgccgatggcagcgagtgtgccgatcagcgtggagagtactgcggcgcaaagtgtgatctgcagcgtcatgatcagtgcgttcatgatcgttttgtctgtaaaacaggaggcgtaccattttaaagtaaatccgccccatacgactcttgatttggaattgttaaaggaaagaacgaccaaaacaagaatcggaagatataaaaataaaaagatgaccgcaagataaatgcgggatgcagccttctttaccatacagcagttcctccctgatctttatcaaaaatattcatgaccgccatacttgcgatgacgaaaatcataagtacaacggaaagtccggagcccaaattccagttgcttccctgcataaattcctgttcaatgacatttccgatcaaaagcactttaccaccgccgagcagatcggagatcacgaaagaggtaagagccggaacgaaaaccatgacgattccgctgatcacgccggagagtgtcagcggaaagataatgcggatcagtacgatccttgaatttgcacccaggtcttttgcagcttcgataacgtccggtttgatgcgcgctatggagttatagatcggcaggatcataaatggcagaaagtcatataccatgccgaatacaacggcggtcggtgtatttaacattttcaccgggccaaagccaaagagaccaaacagtgcgtttacgataccgttgttggagagtaaaagccgccaggcaaggatacgcagcataaaattcatccacatcggaagtacaaataaaaatacgacaaaactctgatgcttaaaatgaaaactgtttaagatcatcgcaagcggataggcaagcagcagacagactactgtacagaaaaatccgagctttaaggaaagcagaatggattttacatgtaccgggtctgcaatcgctgcgatattgtcccaggtaaaagcacccgaagtatttgtaaacgcataatataagataataacgatcggcagcaggataaatccgattatccataccagataaggtcctgctaaaagctgtctgcctaatttacgcatcgatctccacggcctcctcatcctcagattccggtttgttcatgatctggatgttaaacgggatcacgttgatgccgacatgcgtgcccaccggatacatttttgtggtgtgaaccagccattcatagccgtttgccataatgctgatctcatagtgtacacccttaaagatgatggatacgatgtcaccatccataaaaccggcaccaggctctgtgatctcgacatcctccggacggattacaacatcgaccggcgtattacagccgaatccctcgtcgacacatgggatcttcacacctaagatctccacaactttatcctggatcatggttccgtttatgatgttgctgtcaccgataaagtcggcaacaaatgcattgacaggctcattgtagatcatctcaggtgtaccgatctgctggatgtacccctggttcatgacaacgatcgtatcggatatggtaagtgcttcttcctgatcatgggtaacgaacacgaacgtgatgccaagctcatttttcaggcggatcagctcgtactgcatgtcttggcggagctttaagtcgagggcaccgagcggttcgtctaaaaggagaactttcggttcatttacaatggcgcgcgcgatcgcgatacgctgctgctggccgccgctcaaagaatcaatagagcggttttcaaaaccttccagattcactaatttcagtgcataacggattttatcattgatatattctttgctttttttcttgatccgcagaccaaatgcgatattttccgcgattgacatatgcgggaaaagggcatatttctggaaaacagtatttaagttacgctcgtttggcggcagggacgtgatatctttgccgtcaaagacaacgcttcctgcatccggagcctcaaaaccgccgatgatgcggagggtggttgtctttccacagccggaagggccgaggagtgtgataaattcattttcgcggatatataaatttaagtcatctaatacgacgtgatcgccgtaggattttgaaatacctgtcagattgattaattttttgctcatttgtgttcaaaacgcttcttatttttatatagtaaaaaacgttatccctttctaagtggtatgtaaaatacagattaaaaacttggaggcgtggaaacccagatcaggatggcatcacggttgccgttattttccagccgatgttttttccccgcctggaaatagaaagattcgcctgcccggacagtataagtttttccaccgtaaaaaacacgcacggttccttttaatacatagccgaattcttcgcctgcatgtggcagatgcgtgtcggaggaaccaccgggttttaaagtaaggcgcaccggctccatgctgttcttctgggcatttggtatgatccattcgatcattttatttccatcttcgctgattttttcaaaataatcatctttttcaaatacgatctgttccggttcttcgtccgtaaaaaattcggcaggagttgtgccgagacattgtatgatgtcaagcagtgtgccgatggacggagagttctggttgcgttccagctgggaaataaatcccttggtcagttcagagcggtcagcaagttcctgctgtgtcagaccgtactggatacgaagctctttcatacgctttccgatatccatgcgaacctccattcttgcgtgtgaaaaatgttatttttcagactaatctccattctgcaattttttggtaactgtaaaaatatatgttttgtttacaataagtaaacaagactattttatgcattttataggaaaagtcaatagaaaataagctttaaaaaaatataaaaaaggtcttgctttttttatataaattatatataatgaataagtgtggcgtgagtcgaaagacaacacacctcagattgccaatatggctcagttggtagagcaacgcattcgtaatgcgtaggtcgtcggttcgagtccgactattggcttatggattccggaatgccggatggatgagagagcaagtggttcctgaaaagttccgcttgcttttttcgttcgcaggaaattgcgttctataacaggtttttttcctgtatcaggatatgaaaggatacggtattatggcagaagcaaaaaatacaattttaattggaattgcagggggaacaggaagcggaaagacgacgttggcagataaagtggttgacagcttcggacgtgatgaagtcagtattcttcgccatgataattattacaaacgccatgacgagatgaactatgaggatcgctcaaagttaaattatgatcacccggatgcgtttgatacagaacttttatgtgaacatatcaaagagctgaaaaaaggaaaggcgattcagatgccggtctatgattatacgatccacaatcgttccgataagacgatcctagtggaacctgcaccggtcattgtattagagggtattttgatctttgcagagccgagtctctgtgaactgatggatatccgtgtgtttgtagacaccgatgcggatgtccgtattctgcgcagaatcgtaagggacgtaaaagatcgtggacgttcgttagacagcgtcataaatcagtatttaacgacggtaaaaccgatgcatgagcagtttgtggagccgagcaaacggcgtgcagacatcattatcccggaaggcggggaaaatgcagttgcgttggagatgctgatccagagagtaagaaaacatttagaggaagcatagagttaagaggtacaaatgagagactgacgggcatatataatgctgtaaaaatcgcaccaggacgggatgaaaatccgctttggtgcgatttttttgcccccgaatcttcataggaaactacgtcctgtgatcaaaaagtcctcagggcagaccgtcttttaatagagaaaggatttaggtacagcatctgccatggctttgtaaccggcaccactcggatgcagatgatcgccgctgttatagccggctttgaatgctgcaggatgatcaggatcctgtactgcgaggtcgaagtcgatacatccctcaaaaccgtccgtcaggcggatccattcattcacctgattttttaactcttcacggaaaggtgcataggtgcgccagccttcgattggaagcagtgtcccgatataaacagataatcccagggcatgtgcctgatcaacgtaccatttgagaccgtctatgagttcttctgcagttggaagatcactcatggggcggaatggattgatgtcgcatccgaccgggtgaatgatgtcattgatcccctgctggataatgatggtgtctgcgccggaagttggtatttcatgtgaaaaacggttacttccctttaaaccgtacgaatcataggtaatacagtcatactggcggagaattctggtaccgctcgcagcacggcgtataacggaagtatgttttttcccttcccgtaacagccggagcatcagttcgtccggccatgcctgcgcggtgatggagtcgccatagcagatcacggcatgattgtccggagatgtcaaaatatcaatgttactcagaaaataaaaccagtttgtcgttttgcttgtatcaaggggaagcctgccggcagaagtctgatctcccagtgaaaaaaatccctttgagagagggcctgtgatcagaactgctgactgcatcagggtaaaatccgcaaaataaaggttgacacagagagtctggcctgcctgaacctgaaagaaaatgtcatcacttatgatgcgctcgtgtgcggcgatcgtcacggaagaatttccggaaaaagtaatctgtgctgttgcagattcctgcatgggacaggaaagatttatttttcttgtaatgtcatcgcaattaaaatcacagtctgcgatggagacagttgctttcgtgatggaaacaggttcactgccgcagtaattatcaaaggtaaatcttaaagcagttccatcaaacggcgcatagaccggatagcggagtgtgatatcttttgcatagctctcagggcggtgttctgcgattgaaactgcatttccccacatggaacaccatgtctggtttttatttattgttgtattcatcgggttctccatttctgccagaaatttttggattcataggaaaatgtgtcctgtgaattttgtatcagtatacatccttttagagggagggtaaagtgaaacatggattttccttgacttcaccactgtatcatgttattatcacaaacagagtgaacaaagcgttcatgaaggggtacaccaccgcggtagaccatgcaaaagcaaaaaacgcttatttttcaaacaaaatttaatattttggatttcatttacaccatttttacaccaaattagaaatcctttgtatgacatataattgtgaaatgaggtatatacaaaatatgtgtaaacctcatttctttttataaggagtcctaaaatgaaatgctttctcgataaagatataaacaaatgtccatattttttaccagcagaagaggagtgcatatcaaaatctaagtgcagttttcaagaaaagatagatcccaaaattgactgtggatatgttcgtaaagaacgttggtatgaaaaatattataaaaatcgtaaaaaatagggaactacattaatttgtagttccctatttcctctctttttccctgttttctggaatagaattaaaagagccggctacacaacacatggtcatgtaatcggctcttaggctcttattttttcaattctgcaatatcctgctgcattgatttgatctgatttttcgtctctatgttttctttttctactgcatcaacacgtttccacaactcctgaatcacatatgtgttcaatgcgataaattcttcataccttaatgaataaatatactctggattgccattttcatctaagataggttcgttgacttcttcgccatcaaccaatttactgtcaattttttgatctttgcagaatccagcaaaatcgagatctgttaagccacattctgacattgcctgctctacatcctgtgctataaaaccgatatgtgttctgccagatgtaccatctttaaataaaaatgatactggctgtaatttcataaaaaactgtaaatgcttatctgtaagtgatttaatatcatctttataatttttatcagaagttgatatcgaacttgatgtaacgtataattgtgaaaatctataatttgcagaaccaaggctaatagctccgttcattccaacaccattagattcatatgttctaacatggttatcatttgttatagtcattgctctatttgttactctatttcttattccctgaaccaggatatatgtcggattatagacatacatattagttccatcgctaccaccccatatccaggctggggtttcatttttaccgctccaattccaatttttattacatgatgcagaggttgataacttagaatttaataaatctgtcacacttccgacatttcttattgttattgaattgcatgtaatgtttccactcctgcaatctattccgacagtcattccttgattagaacaaccatctacaaatccaactccgtaccatgatttgatgattagatttgcaacgtcagccccatttccatctccgttaccattaaaaattcctgtatttccggttgtctgaacaccgagaaccattccattagcatctgaagccgtactacctggtaacttatgttgtccaataatagtgccagtcattgttccacccgataatggtaagtagttaccctttgctaaactgctgcttaataaatttatttccctctggaaaagatttaaacttggaacagcacattgatttgtaccagtcacttcttctttttcatcatataccataacatgtccaagcggatgagtgttgccaatgcttgttattgcctctatttttttgtgcgctgttaaatcagctgatgtggcagcaccgatgttttccggtgtgaggttaacatttcctgttctgtaatttttctcagcgtctcctttgatcccagttaaagaacttccattagaccatttttgaaccaattccgaagtaataccatctaaaacagatttattattatgagaatgttttttgttatttgcgtcattccatttagttctttcatcggatgtaatgtgaatagtgtcatttcctgtatgagtatctaattcattttgatttgcttttgttcctatagatttatctaatgcttctacaacagatttgtttttttcgatggcatctgcaatttctttcaatgtatccattgtttcgggagcaccattgattaaatctgctattttttgatctgtatatttatttgaattggcataagcaccatcaattgctttctgttgtgctgtggaaacaggtttatcaacatcagaagtattatcaacattccctaattgaatctgactttttgttgttttatgtgggttatcgaaattattaatgtgtccaagtaatgaagagatggctttttgaatttttccaaacgcaatagacaatttttctccactagagatattttcaaattcctcggcttcttcatatgttggtgtctgatcgtttgttgtaacatttggcacattgccgagtccaacttgttctttatttactttatgtggattcataaaatcaatcaaatgtcgaatcattttttgaataatattagattcgatgacagattctatttcttcatcatttattactgattttttaacaataatattaaactttcttgtagatatagtttcttttggagttatgaactgtaattctgcttcacaaatacctggtacacatgttgcttgttctgacaatataatggatattgtaccatcatcattcctaaacaaatgatcagcatcgtcttcatctatatatacatatgtattgtctggttttgaaatttttagaaatattcttacttctgaaggaatactatatggtttcccattatcagacaaagtaataagaatatttcttgaatctgcatcatcttgactacaatgcacattctgcactcttgatattgtcaagtccaatgtgattttttgattaaaaactaaactcatttattgtatacatctccttcctaaattccaactttccgaataggagagtaggttatttttattttgcaattcaaattcggcgtgaaagtattacaacgctcattataattgttgataattcgtgggaagaaatagttgaagtcatttgctaaattatgagacgagagagaagaagtaataagttgatttttcccatcaattgttattacctcgccagatttgcaatttcttagcataaaagattttgtatccatagaatttgtcaacttaaaatttccttcagataaaatagtaatttccatatctggtctaagagaattgttcaagtctgtagtctcatctgagttatcccacaaattaaaagaagtatctgccgagcattcatactcagcagatacttcatccataaaagcaaatggtgcatccgtatataatgttagttctaagcctaatatttggtcatttaaaacgatttgttttgaactgaatgttccgttccaatatacatgttcatagccttccttgtctaatttaaagcgtttgtacccatctttacgacacaaccatcgttgtatagctgaaacttcctcgcatgaaagtctcatttcttcttgattttttaatcgacatggattcttacaaatctgaaaagtagctgataaagctgtatcgtaagtggaagaatataaattaaagcgattgctgccgataggctttatctgattaaaggtaacatctgctccagaagagacagtttctataccgcctccactatcaaaagaacagagcatcataccataatcagatagcatttcaccagcatattcaaaatctgtacatcctttcatgttttattcctctgtaattaaattgaaactcattaagactgcaagcatctgaggagagatagttacgttcgataatgatttcatatcaatagattttaattcatctacatctacatcctctgaaaacaaagtagacattcttttattaaattcttccttgtttataatttctttcacagaaccatcatcgtttgtaacaacctgtccattttcttttaatgcgcaatcggcaacaattttattccttttctcatctaatacctgttttggtacagataatatttttatattattcacaatagtaacagcggtatttaagtttacttccttagtagcaagaaacgaaaatacctcactgatatttaagatatcaattccttttaatttcatcctctgactcctttttattattataattaactatttattctaccttctaatgcttctattctcgattttagactattgacttcattttgtgttgcagcaccgatgtctgccaaagtccacccgatattatctgaaccgtcaaaaacccttccaacacgacctatcgtaagagtgcgtggagtttttaattttgttgcagtggaagagttaccatttatagtcccaagacatgtgatattacctgttgtctcaattcctttaaaattaattttagatgtggctgatcctacagaaaatggaacgatagaaatttcagaatttgttatatttacaccatatccgtcaccagcatctatatgaaaactagacgcaaataaatcatttgcataccattttccagacaatattggataaaatacaccatgtataaatgttgacgctattacttctttgtaatttgaattatcatcaaaatctcctaatcctgtcatataaatagaagatgatatatacggtgaaatcatatatgcattaccatctgatgttgctttaaatttatttgctaaaaattgtgaagctttgataattccaccagaaatagtgccagtacaagtaatagtattagaaaatgtaccaccgttagcatttattgtaccagtaacttttaatccatctttagaattatatgtaactccaccgttagcaagattaaggactccttttgatgtgatatttccatcagaatttacgacaaaattatcattattgtttccaccaatcccaatacttccaccacgaagagttgctcctgtaattgttgatttggagattactgatccgtcttcatttacaacgaaattaccatcgcctatgtttatctttccaccatcaaagctacagccgttgacatttcctgtcaaattcaaattgccattatcatctacataaaaaatatctgtattatatttagaaattttcaataattttgctacactatttggattgacagtaaatgtgtttattccatttgtaattcttaagccatcaatattaaatgtcatagaattattaaggttatatattccaagattttccccaataattaatttgccaacaatagtatctccaataacacccatagtagttacttcattacctgtttctggatcaatataaatatacttgcctacagcagccttaacagatttccaaccatcatcagtcacgtataaaccactattaatccaacgtgactggcataaatcgtatgtatcaattaaatcgtcatatgttctacataaaataccactagaatcatatacgacattttgattatcagcattatttacaatttttgttgtagtagcttccattcctttctgtgcccagttttgaacatacttagaagcagcaacattattttttactttttgagctgtatatgagaatgaagatgccatagattgtgcattttcaatgacactttgaatatcagatgaaccagaccatgttctttcaacagtagaaaattcaacctcaatttttgaaatatcagaatataaaattttataagagagtaatcttaaataatatatcttctcatctacacatacatgaatccaattacctgtttcaaacttattcacaataggtttaaattctggaagtgcaagaagattattgatagtagaagtaactgtatattgtacatgacttgctttatataactctttctttgcagcgtcaatcagttccgttgcacgagttactagctcaccattatctaatccatcagagatataattatcattctgataggtatcttccatacgaaacgcacaaaattttgtccacatatccttcccaagatatgtttctaagtttaattcatcttgcagagaattttgaatatcatatacagtgccagatttattatcatagttatataatctatggacagcatcaatttgtaactgtcttttattcatttctgattcaagccaaccaactcgattactataccaagtctgatatttattctttaattcttcctgttcagattcaagaataatacctaaaacattaccaaaagaatcctttagactactcaaatagtcaaaactgtaataagccaattcagatttaaaatcagcatcagatgtttctaagtcttttaagtctttataattcgtatcaagcttgtttaaacatctttggatattctgtttgagatatgtttccatatcattatttacaataatagatatctcatttcctgtgagagtaattgtattatcctcaatgcttgtgagtttaaatttacctttccaagcatgatttgttttgtcatatgaagcatctacaatttccactttatacaatgcagtattaattaatgctttacaagaaccaagcacagtatttgatacaacacttgttgcaaccattgataaatctgatttaactgcaacaggcgataaattagaagatgtcaataaattcattgtctcttggattgtcaaattatccatttctattgttttacccatagaagtctgcaaaattaatccaatatcaatgcagtcaaaacatagcgaagcaatatttttatatccaacaataggagatgagatagtattatatctatcaactttattgccgtcatcatctattttttgataatgttcatttacatatttgacaatctgattatattggttaacttcattcgaagaaaagttaaatgctctgctatttatacattcttgatagtttgcattatatgctttgattttctcgactaaatcactcggcatattctcatacatttcatcagaaaaattgataatataatttgtaccacttggatttgcgatagcaacagcagaagacattaaatcgtctccaccaacaatataaaaacaattctttaaactatcatcactactttcaatagaagcagaagtagaaagattctcttttgaaatataaattgttgtatcttcaccaaaagcaccaccaatatttgtacttccacattcaggacatttatcatgaaaatctccacgatacccacaatctttgcatgtattacaaagatcatatgcatttatagttcttgtcgttgaatcgaaagtgaataaacattggtaatcatctgagatttcgccagttaattcgtcatatacgttgctgtcattaatagagtactgaaaccatgattttaaatttttcaaagaagtatcaacatgaccaattttataattcgatgctttgtctaaaatacgatgtagaagagaagagttatataatttcttatacatttcacttccttctgaaaaagcagataaatcacgataaaaaatagttgggtagttctcatcataatcatctctcgcaatatcatcttctgtattaatttcaatatttctaagttttacattctgcaattcatttacaggaagatatgtacatgtaacagatttttgagttgtattttcttctgtagtatttacagtaatagaaaaatgttcattatactcaggaatatataccagattataattgttaattttatcccataattcattttctgtcttatatacagtaaatgataactctggtgcatttaatgtatctttatattcaatgtcagttgtatctataagttttccgtatttatgaaagtcacgtctttctagtaagatagtaatttcatctacaccaaaattctcattaaaaactatttttggcatttgcttattctcctttcgattttttttacatataaaaatcccacataggctatgatacctacatgggataaagtggttacttatataaccttgcattacctatactatttttcttaagttgcttggcagatacagcttcagtaatacattgtgttgtttttccgttcttgcaaatttcttctcgcaactgtctaccgaatgtttcaggatcattaacaccgttcatcacgatatctccaacctcaacaatcgtagaagtgccagcagattttgcaatatcaggtaattttggtacaaagttagtactagagtaaagaagagaaggattcgtctttgcaagttcccaaagattctcagtcatctcatttgtgaacactttatcgccaggattgagttctgttaaaagtgcgccgtcagcagcacgataaatcagttctcgtttattttcttgcgtccatgctaattgactcttgtctatgtgttcagaaccttttttatagccattaaatttcatcctattaagaatagcagttttttgtttcgatgtaaccgtgtcatctgtttttacgcctagtatgccacctaacttcttgtacattttattagtaggagttctaccataattctttacaatatacttccataagtcagcatgttctttgttctctttatcagttaatttcttactgcgagatttaccagaattaatggcatctttaactgctttcttttcattttttaacttatcatcaatagaagttgtatttttcttttttgactccaaggaattatcaagagttatagtaccaactgctgttggtcgtaaaagtccagttttatgagatgaattgatagtattccgatcattagtaacagtattatttacataatcctttgcgccttgtcctccgtcaccaccattggtagtactagaatcaatctgatcttttgtagtatttgtcagacttgaatctaaggattttagtgttgcaataataccatcattgccaccaagaagttctttgatactatcgagaattgtatttgtatcattgattttttcatcaatgaattcctgataatcactcatcagatcgtcaagcatgtcctcagtgtcagaaataaatttttcatattgcgtatcttttaaatctgatttggcattctctaattcaacttttaacttttgaattgttgcacgggattcttcagaattgttgccagtataagctgttaactgtttctgtaaagaagcaatctgttttgtcttttcggcaatttctttctgatatctataggcttcaagttcggaatcttttaatttcttgtatttttctatcagtttactcagcgcatctgtttgtgcttcataaccctgttttacaagatcattaatagactctaactcatcctcggcagattttttcgcttctctatgagcatcctgtaaatcacgcagacgttgaataacattttcatcggatgcagataattcgcctttctcaatctgtttcataattttatcatattcagactgatatgcttctgcctgcgcaatgtaattgtcataattcgtcttgtgcaatccaatggtagcaataccatattcagtgaaattaccagtgtctttatcagtcatatctttatgactcaaaagatcaatatagtaatcagcttcactgttaatacgttttacagtttcaagagatttatcaaaagtatcccattttaactgacgaagggcattctggtattgtttaattgattgaattgattcgtctatagcatttgttacttcgttgattgcagaaaccatttcatgccattcatcgctgccttttttgatagaacctttgataacagcatcatttagactcttttgaagatcttttctttctttaataagtttgtttttctcacctttttcagaggagataagagacttataataagccgcacttatctgtttgccctgttcttgtgcgagtgaaatcttattattaagtgctgtctttttctgctcgttgctagaaattttgttgtcgtaatcacttgagatattatcaaatttttctttcgcaagatctgctttatcctgttttgctgtttctttatacaggtcagcagttgctttgtctgattgttttgcatcccaatatgcattgtactgtacacatgcattgtagagcttaccattatcattcagattggatgctttatttaataaagactgtgagatacgtttgccagattttgcagctttcttaatagaagcaaggatctttttattctcactcgtagatttgaatttactaattgttttctttgcagatttaagatttttgttatcagtagaaacagcagtattataagccttctgcgtcttattgatattagagatctttttgtcaatcagtttatttttagattttgcagacgtagcattgtcaattttagcatcatataattcatcttgtgaatcatatttttctgtctttttatcagcagtcgcttttgccaacgcagcggcggcagtagcattttcctgcatttgctgttttaattcgatcagagatgccttatttgaatcaatacgttcattatactcataccaagcttcagaaccttttgtaactgttttctgtaacagttttaattgctcatcttgtttattaatataatcaatctgcttttggatatttttgttcatactatcataattcttagtatttgcagaaaatccccatgactcttttaaagagatccatttctccatgcggtcattcgcattttcaacttttgtagaaagattttcatactgagtgataagtaattcgatacttgcttgagttaattcaagctgtttatcttttaactcatctattttatccaaacaatcctgcgctttatcataccaattctgatagtccttgatttgctgttttacagtatcatctgaataatcccatatattagaagctccaccacgaacagcagaagcaatatcttcattaagaccaacttcatttgctttctgcatatatttgttgtaatcatctgtgagaagttcaatgccaaatgatgtagcgtttaaagcttctttatatgcatttaaacgagatgtgaatgaggaagaagttttggcggctttatcttcgagtttggaaagtgctttatcaaaacgattgataccattttcaataaaatcaaatgtttctgcaacagcttcttttacatcttttgcagcatccttggctgcttttgcagcgtcgttaactgctttcttggtagcagagccaccagaatatttatattgtttcgtaagaacactatcaatttcatcctgtgctttttcttgtgattctgtactataagatccctcatcaaatattttagtatttccagtatgttttttcgtcttatttggatttttaagctgtcttaatacaccatttttagcattttgaaaagcatttaattcatcaatagctccaccaagagctaaaaccaacttcttaatattttcaatatcactatcggtcgtaagagttgtgccgtttgcgagttcttttttcaaagcatattgtaaaagataatttgctgtttcctcggaaactttaccttcttcgactaattttaagatatctgctgtagttgcgtttgctaagtcaaaagatttcagagcagcaatttctttagccgcagataatcgttgaagaactaattcatgactgttctcaacacccatctctgttaaagtctgttcgataagtccggcattttgctcattgactttatccaaaattcctgactgttcgatataagcccctgttaaggaagacatgattttcttaacttcctctgtgttttgaccagctttttggagcttatcaatataattctctataccagaaacatctttgaaagcttcagcaatattagaataatcctcaaaaccgatgttctcatccttgtcaaataatttggcatatgttttatcaacaacgtccatcttttctttgactttatcgagttctgcgatggtttctgtcagagataaatctggagtttcatttggtacattttttaattcatcttcataagcaattattgcgtcctttgcattttttgttcctaacgttaccttattccataattctatctgagaatcagtaaaatcttttgtatactcttgaagttctttataatctttagcgtcaactcgtttaccagaagaagttgtaaaatcagcactgccaccctgtgaaatagattcaatagaagcttgcaatttgtctttgacttcttgctcattagcaattattggagttatgtcaattgtaattccatactcatttagttttgtttgtaattgctttgcaaatgacaatacatctaaatcaccgtcttcaaatgacaggagtttattaaacatattattaatttcctgtttatgttcagaaggtatctccattaggggttttataatattttcttcgacgtaattttgataatcataagctgtttctggtggtgtttctaaagaactccaatctatttcaggtattattttatctactaatgcagaagaatcgtctgataaatattgataatcataattatcttttacccatgcttgaagatttgctgtcattttggaatatgaatcttctatagacttttcttttgtttcaatatcttgctttaatccattttcagaggcatgataatattcattttcggtttctaaccatgtgtcataaaaagtttgcgctttcgataactgagctggtgaagcagttattaattgaactgatgtatcatacattccataaagttctttaaattcaatgccagcacgattcaatgcatcttctaatgctttcccatatttagaaaaatcttcatcattaaaattgatcaaaccatcagaattaatgatatcgacatttacatttttatactgttgttgtattgttgacaattccgactctaaatcagaaatcgactgctcggtattttttacctcataataaataccgtttgcaacatcgtccatgttgtcaatcaaaatctgctctgcaatcgccttttgttttttaagaacattatctaattttttacttgtttcttctgcactatctccaatatttaataatgcatttccttgatcatcgtatccagagacaagagatggagacaagtcagcaagcttgtttgatatgcttaaatattctttataatcctcctcagaaagagaaaggttatttgaaaattcatctactccttttgacagttctaaaaacctatctttattttcagagatagtagaagacatatcttgaagcgtactttgtgcatcatcaattttttgctgggcttcttccattgcgtcagcagcatacttcgcacgatttacataatggtcaatcgcatcagcagctaattggatacctttaatagccaaagcggttacaatcatgttagcagcaatagaaaccgccatatatgcagcagactgtgcttttgccgcaactgttgatgctttttgtgcagccgtaagttcttctgtggagattacagccccttgtgcagatgtcatcagtgaaacagtctctttattagtatttctgcttgcaattgctaatgcttgttgaaattctgttccttttgctatttcggaattgtattttactatggcttgcacatctattttcgatgtattaaaaatggcatttttaaaaccaacagattgaatatcatacaatctcgtttttatatcatttagtgataaaccaaatataccaatagatttaatagctccagaaatatcatcttttattgttctgaatatcatactatatttgtttgcattatacttgtttgaagagtataattataaataaaaaggagcttaaatttatgaaatatattaaggtgtgttatatgtgtccaatttgtgcacaaggatatttttttgacaagtcttcgcaattttcaacagaatgtccaaagtgtcatgtagaaatggtctgtgtagaagaaaaaaatacaacaactgaaatagaagagagagaaagtagaagatgggaaaatggtaaatctgccatactaatagaatgtccatattgtcattcaatgaacacttctaaaatcggtacagttaatagggcgatatcagtcggcatgtttggtcttgctagtagtaaaataggtaaaacacacaaatgtaatgactgtggaagtagttggtaggattatattatgaaatttacccctaaatcaaagcataaaaagaagaaaaaacatcagcaaaataattataaaaaacaagataatacaaatattcctgtacaaaaagtttcaacaccaaaaatcaatcaaaatcaagaaaaaataaaacaaaactgtccttgtaataaaaaaggatggtgcatttttgctgatagaaaatgtgtcccatatgctctgaaatgtaaatataataaagaagtatttaaaaataatacattctattatccaacggaaagtgccaataaaacgaatacatcaaccaagaagtcaagttataacttgtatgaagatgaaagacatggttcaaataaggtcataactactttatctgataatagtattgtagaattatatgtattcaaagggttcttacaattaaacccttctcagacgatagattatgagatgacaattaaggatcttcacacaaatagaacaagtactattttagttgcatataataaaataacaggaaaatattatatctctgagactcagattaaatactggcataaaagaaatttcttccctaaaattgttctcaatatgtgcaatgatggttctattcccatgataactgatggtttccaagaattttctaaattggctttatatggatataaagttgggactcatggattaaacgagatacaaaggcataaaattcttaaatatgttattgataataaaatcatgagaggatatgaaattataaagcatctacaaggattaatattcttgcggaacgagcaatataataaggacttttcaactgcaatagaagattgggagaatgatattatttttattgaggaatatataatttccaaatcaaaataatagagtagagtaccaaaatgtcctacatgtggctcacttaatgtagaaaagatttcaacaggaaagaaaatattcggaggtgcaatgtttggactattcagttcggacgtaagaaacacaatgcactgtaaaaattgtggggcgaaatggtaaacaaatgttccgactatacctgtataataattagtggtaaaatattcctatcaaataaacagagggcttagagttaccctctgcataaatatgtcatttattcaacaaatccaagaatgatttttgcaatgcattttgcattatgttcatctaaatcctcgattattgctttggcaagatcaagattgagatatcccaatgccattttttcttcatcagttggattgccattatgctcaagagcggtgttgaatttttgacaggtttttttaatagtttcaaacatgtttttacctgctttctataaaggagttgtttaccatgagattaaatcacgactatgtaagagatattttattatttattgaaaaagatttggattacaaggattcttcaaaccctaattatcgtaacgaattaccatttggacagctacttgtttcggataagttttctaaatacaataaagaagaattgacttatgcacttgaattattgacaaaagaaggtttcattgattgtgcaaagaacccatattttgtaagaggaagcctaatgcaagctgatattataggtcttacatggagtggacaccaattgcttgataacatcaggaacgatacggtttggaatgcagttaaagaaaagtctaaaaagtttggaaagttctcactcaatacgttggctacttgtgcaggacagcttacaattgctcttatgagcaatccgaatgctgttcagaatttcttggatggagtaaataatattggaaatatggtgtaataaaaaagagtagcctaaacattattccagaattcaataacaattcttgttaaagaaatcggttacattggctacaacttggtctgtttccacggagaggacacatctggcaaaccgttggaactgatacagcatgtacaacagttgaattttcttttaatggttgtaccgaagcgtcaaataagttttgtaggttcggttgaggaatgagtttggataaatcaatattcatcatgtcaccaccaatctaagagtagatgaaagtctgctcttttataatatgtgtcaacaataactatttatcgacatattttttactttatatattccaaatatgatataatttccatataggagggtatatgagaaaaacagtattaacattagatgaaattaatctactaaagaatagtgaagaacccaagaacactcaactatatggcaacttatatgaaaatatagtaaacctgtctaaattcaaagcagtctcgatagaagatatgccatttttagatgaattgggtgtagcatcacttactattaataagaaaaacatgatgaataatattttaaaagaatggtatgctgaaaaagtaagtgaagaagatccaactcaaaaggtgcattgcggtttatgtaatacacctaataaatatttatattatatacggaacagacgaaacgatatactgctaaatgtaggttctcactgtatccttaaatttcctgggattgaaggatatacagagaagaaacgtcaacttaacgaaatcatcaaaggtcgtgaagttgttaatcgaagaaataaattttatgagacttttccaaatgccgaatctgtaatttcagatgctgataaatatttttcaaccttaccaattttaatcccttatgaattatatacaaatatacaaaacaccatagtaaaaatgaggcaagtatattcacaatatattaataaaggtaaaacaaatttcgatggcaatttgtcaccatttgaattatttcaaaataaattagatgaatataatctttatacaaatttagcaaatgaatttatccaagaaaatgacaagcctttgagttgtagacgtgtagaaattgactggttaatttcaaataagaaaattgaacttctcgaagaaatatctaaaaacaatggattatacaccgaattaacacttaaacacatgacatcggttgaatttataaaaccatatataaaaaatatattttcaagaaacacttcgagacaattatatttttcgcatataaaaggtaatatgatatatattaatttacataaatttggctataatcctaatttagtatttcaaatgacactagaagattttatggacaaaataggtgcaaaatgtataattaataaaaacataaaatatgatcttgaaaaatattttaaccaaattgcaataatagtcaatcaatctaatattttttctatattaggctatatatctacttatacaaacaatacgcaatatgtatttctaaatgattacattagagataatatatatttatatagaaaaactgataaggcaataagaaaattcaatgcgcaatcatttattaaagcatattcaggacatttgttaaattcagaagagacaatgaagaaacatattttgaatatgatttataataattcggttcaatggatttcattagaacaacagagtaaacaaggaacagacgatattgtaagaaaattgtacaaagaatttaaagagtagccaaccgactactctttaaatctgttactgtaatgtttttacaattccacgccaataatcgaagcgtcccttaacattctctttgctacctgtaccactctgaacatattgtttatattcttcgttagaatcatatgttgcaataaactcagataccttctctgcaagacgagagaatgatttcttgtctttaacgattctataaccactatataaaatttgtgggatacttgtggatggaatttttacttcaccatcaaatgattcgttaaatctatccatagcttcttttaatgtgtcagctctatcaagaaacttatctgcataatcagttacataagcatcaatatcttttgttctaaaagatgtaaattcctgttcctgattagaagatataagcatcatggcttggataattatatctctgtctgttccattctttcgctgtgtctttgacataattttatccataaatggatgattagcgagagagtagaccttttcactgaactcatctgattcatgcactacacgcatgagcttgtttgacaatggttttcctgcattctgtctgcggaaaagctcacgaatatctgtttcagtgcaatctgtcattctataaatttgtaattctgattttaaaatttcatcctgagtatcttcatcgagtttatcaaattttaaaccagacaaatccttttcttcaccattaacaataatagtacccatatctttcgataatgcaaatacattaccaatataatctcttatagtagaaagacgctgtacgccatcaataattgataatgtcccatcttcctctacgataccataagtaggattaattggatagtgacgaagcaatgaatcaattaaatctgtacgttgcttacgattccactgtccctctggtcgctgtaatttatgagaaagattaattgtacctttattcatatcctttacaagcgactgtaaagaacgagtttttgctgtataatccattatgttacctccttcaaaaaatgaaaaattttactattttgaagataacacagttggaattttttgtaaagttttttgaaaaattttgattaaatttcgtatttcataaatcgacaaaacctatgttctggatttatgaagttggaagtatatggtaatataataccaagcaaactgtatttgagccatcgtatctcaggtcaatagcacgacagaatgctcggtatttaccatacgaagtgccatatttgtagtttggcacgattcatatcggaaataaattcagctcgttctgagcaatacatttcccaactttaagaaatactacaaagaagggagggtagaattggaagtatttaaaatacttgtaagtggtggacttttagtatatgcttgccatttactttgtgtcatagttgatacaattggaaagtgttatactgttaataagtgcaaagactatacggactcacaaaccaagtctttatcacaaatgttcaccaagactagaaaaatatttcgtaaataattctatttctgtatttgtcatttatttccttttattccttaattgagggcaggtcatcacgactgtcctctattttatttattttacaaaatatctataaactactttcaattatagagactgtgtgttatactgcgaacggatactttcgtattccgctatataatttttcacttacattgtacacaccaacaatgtagtaaagataacatcgtgtaatgcggtgttatttttatgttgtcatatatttattctctgttttttctcgacaagaaatcgagatttcttgatttattcgatttctgtgaattcaatcttacttattgcatattttgttatacaagcaaaaaatactgctaaaaccaaatatgagataatatctgaaaacattgaaaccatatttacatcaacggttatttttagtacatcgcatataaagacaattatcatcccaataaaagcagtaagacaatctattgcaagaccatacaagaaaaatcctattgctagtgacactaaaattaccacacataggcaaacataattcatacgaataaaatcatcttccataaatttcttaaaatttttacatctcttcaatcctttttctccttacgaataaatgttctctctaccaaaacattccagtttattatataattattttacagcttcaaatgaaaatacagtcacttccatttttaaacggtgttcctcaaacaaacaccaacaaatagtatgatattcaaaacaataacaactattggaggtgactgttatgagtaatatgattaaatatgctgttaagtgcaattctttatataaacttattgcagttatctctgtatgtgctctgcttggatactgcaatcattgttggtgcgatacaatccaacacattacagataaaatttgtgaatataaagaagttagcattaaagctcagtacgatgacacctctttagaggttgatttacacgagcgaaatgaagtagggactgagtagagcagttcctattttatttattctctttttattatgtgtttcttcaaacttacggtacacacaaaccctactgttatcctattacctattgtgctatgtaataggggagagtagcaacactctttaacggttttatatcctagtcactgatgattctcactcatcaaggaacagtccgataactgcgtatggagtacctatcacaagctatctaatgataactcaaaatcgtttatactctctgaacacttccattataatattctctattacagtagaatccgttgctgattgccgatttagtccattaaggacatgatacttagggtttccccatatatccaaataacctccatttctggatttgacttttcttgttgtcaccaacatcctttcggaatacattcacgctcgccatttctagccacgttgtagtgtgttattttatatatacggtatattttatttcttcccagcactgtgagatagcaactcacaattacgatttattttgaaacatctataggttgactagacctaatcttcccaactcttgattgttgtcttaagttaggtgggcatattcaaaacaataacaatgatttgaaaaattacgcactcacgtaacatttaccgatgtttttaaaagctaatacgcctgtaattcctaatgcagccgttttaagtaatccaagattgcctgttacaaaaccaattccttcagacaatttagttaagccatcaacaatagtacctagatctccacgatcgaccatttgctgaattgtaccaacccaagtttccttgagtgcgttgatacggtactctaaagattgctcaatagtttccatttccttgtcgcttgatcctgcactttgttccatttcatcaagagccttggtaacgcctttatagttctgaataagagcagcaccagcctgagcctgtgtacgaccaaaagctttaagaaggaaatcattttgttgtttctgtgacatttcatcccagatgtcagcaatttcaccaaagtaatcagttaaatctttaaattctgtagtagaaccttctttaaagatagatataccttgtgcgtgttctgctgttttagtaagatcaattaattctcctgttatattggctaaatctttcgagtattcttctgtcgattcgtcaaatgaacgaatacgaagtgcaacactacgaagggctgtaccgcttttttccgcattttgcaatacctcttgtatacctgaaaacatagccaaaccatcttgcactgatgttcctacagcggcaagggcggcggcagaacgttccataccttcaacaatatcttggttagataaagccattgtgttcaatctgttactttcccattatttaatggtactgaccataattgattatggcgcatagtcatttctggctatgtctcacgtttcattattagattatagcgtgagatcggactatatattacaccctcttatttattaaagtagggtggataacttcggtaaatatgctttttatcacaatataaaccactgtagtctctacgcattcttgataattactcacaacaaaaagaactatctttattatattttatacctgtaacagaactccatctcaatccagataaaattctacttattgttccttctgaggtatcaaacattttagatagttctacttgagaatatttattttgttttgataaatcaacaattttcaaaacttgttcttttgttaattttgcatttgtgttattttcaccaagttctgataaacgaattttatttatagactctttagaatgaattaatccattttgcccttcgccaccaattgtttgattatatccttttttatttaatatatatgtatcataataagaaatccaatatttttctttttcatttaattcttctgatgtatctgcacaatcaattatactccattttaaattatcaacaccatattttcgtatcgctctataaaatggataattgtaactaatttctgtttttattttagattttcttatatgttcatttattcgttcttttaattctctatgtgtttgtcctatatagctcttgccattgggcaataaacatctatatataatcatattattcacctcctataaagtgaataatcatcaagtctttgctcggtctcatccttctcaggactttaaccgatatagttatctactatgctatatttttatagcaccatacattactgtatgtttgggcaataattttacccagcttatttataggatccataatttcagattttacttgatctggatctattgaccacgccttcataatgctgaccaagccactctgactttcatcaacactcataccaggagaaatagaggcaaactgagaactaagttttgccatttctgtagaagcttcagcagtattgtatcctagcctagaccatgcacttgcctgatcaataatttcttttgtagtaacacccatctgttttgctacgttattagaatcataataaaaattctcaagctgattctcattcatcgctgtagttttttttaaatcaaccaaagcagtatcaagttctgtaatagtagagacagcttttttaactccgtttaccatcccatagaatccaacatacatactcaaatagctttgcatctgaccaatgaaaccatatgtagactttgttttaaaaatatcccaaagagattttccagctctaccagcagcaatttcagcattttcaattttaataatttcttctgtgatttttcttaaattgatacttggatcaccggattttaattgttctaacaatacattaaaaccggctttggcttccgcagaatattttgtattctctgctaaatctttattgattctctgaatagctttctcaacgccgacctcaactgtacctttttcagcagcagaaagttttttgaattccgtagctgctttttcacaattctgtgttaatttgtttatttcggcttgttgttcttttgtaagttcattaacaccttgcaatgaagatttataatttttaagtacattatttgcactttctaaatttgcaagttttgtattatattctgtacttgggtgaaaatcggacggatatgtttgtgcttgagtaatgatattttgatatttatcaatagaattttgcaaagaattcaactctgaatttagagtattttttaaagagtcttttaatctattaaccgattcagccgatccatttgatgcctgatcgagccgatttatcacgtcaacatatcttttccatgtatctgtatctacattctgaggatttatcatagaagataaaacttgtcttgcatcataagcttctttttttaacttctcaatttcctcaatttgtcctgcgatttcatatgacttcttaccagtgcttttatcagaggctttaaggttattaagttttgtaacagcattcatgtaattctgaattgctttttcggcttgttcccattttgactggattgccattgcttcttgctgtactttttgttcagattgtgcaacctgttctaagttttcagaagtcttaggaaatgtgtctttcattccagatgaaatattcgttttctgtccaatcttactctgtgcatcagccaacttctcagcttctttagcagcatcttgatatgcattactaatattctccacttgtttgacagcaccactcgtattaccacccatgttgttcatgtttttattaacattgagaatattctgattcaattcagcaagtgacttatcaatgttctggatagaagagagtagtgtcttcgtaccagaatcatctactttaccaaaagccttacttaaactttgtacttcggatacaatacttgataactcttttgataaattctcgaactgtttaaaatcacctgttcccttaccaagagagtcaagcatcttttcgagattagaaattacattagataatttcttttcatcaatattaaatttaattgtatattctctaccctcaacagtatctaatctgtcttggacttgtttcatatctttaagcagtttttctacatttgatttaatttctaaatcatactgatatgtacctggcatttcctacctcactttcttaaaatttgttctattcttttattgataatgtcatccaagcgacctccaaatccgctttcaatatctcgttcaacatacatatatggaggcaatgattgatgtttcatccactgaccataaccgtgctgaccacccataaacatataatcaaatgcaagactggcatttaatttttgatgattaccttttttattagaatatttcccgtcttctcttggtgcatcatatgtatttccccaaccatatccagcccaaccgatataattatccattacacctgaatctactgaaaaatgaaggacatttcctttgcctcttgtttttgtagaatcaagaattttcataaagttgtatgttctttcatatgactgtggagtatagtcgttgtaccaatctatcaatgaatatctgacagattcttttagcagttcatttgcttgtggtgcgacttcttctgcaatatgattttcaattctgtctaacttctttttaaaatctgcatatatattttttgccaatttcatcacctccaaaaatttcactataatttcactatttttacactaaaataggagagcagtattacaactctccataagaaaagccctatacgctgtgacacgtatagagcctaatatttaatctaaatatacctctggaataaaaaacaaatcatctttactattgtgttctttcttataatctttaataatatattttgcagttattttattaacacatttagcagcttggttaatatcatctgtaacttctgaattaaacgttaaataatagtctggatttccatttgagatacatatatacaagtttttattatccataattcactcccttgaaatttgaatttacttatacctctttaaatccaccattcttagcaaactcaacaaccttatctaaatcttcctttggaatctcatcgagcttcttacttacaacgtccataagcggtttgagagtagcatttgccaaatcagaaatccttccaatctgtttgctaataaacacctgagtagttgtctcattaaactgagtatctgactgcttcattgttaaaatggttttaaattcacttaattcgctcataggaataagtggatcagctttatcagaaccaaccattaaaatatcaagtaagccagatgatttaagtgcatcatatccattgataaaacctttatcatcctcatcaatctcaagatcggtatataattcaataacggcacgacaaaactgtacatactgagcaacagaatttactctaatcttatctgttttacgatattttgttactccgttatcatcataagattcctgctcaaatgttgtcttatctacaatcaactgtgcataagcatctttcttaatgaatgatacatatggtgtaattttgattgtctctttaacaaatctatcctttaactgctgattcgccatgttattgtatctctctacaaattctaaaagtctcatattcctttttctcctttaattcttatttttctttgcttctctacgaagttttttcaactgatcatattcaatccaaccaccatatttaagatttctacaaataaacgtaaggttggtttctgggtacttagcccacatcatttttctttttaaaagtgacatactatctggattacccttcacgtcaaaaacctgtaaagtgccatcagaccagacgacattaaaatcacttctatatttaataggtagaattgttttacctttatatttaaatttatcttgaagaacatattctacttggcgttcatatgataatatttctccacttttcatcttaggttctatatattcttgtaaaaatctaagctcagtaagactgtcataagttacacctttatatgttcgatttttcttaccttgttctgaaatatctacatgatatttcgatttagcttttgctatttcctttcactcctttacataataaaagagcagcttccgaagaaaccgctctttcataattcttatattcaattgtcatatgtacttggttaattattaataatcataggataaagttcccacttggcgttgggatatttttcaatgtgttcacaaactattttgtgtacttcttccatatcacctgcattcttgtcaatatgaattactttcccaccagttgcttcaacttcttcacatatcaaattaaaatatgttctcataagcaattcctcctatcgcttaatacaaaatagttcatacaaatccacttgtaatacatgtgatagagaaactgcgttggacaaaagaatatcagaagtatattcattttccaaattggaaatagcagtagtagacataccacttcgttctgctaattccgcaatagacatattatgtttatatctgtattctccaactttgttcttcatgtatttagtatgtatagaactatttttattatgcatataatataaaagaaacttataagttgaattgataatttatttgatatgctagaattgttgacactaaaaattatcattccttaaatactcttggtatttttcagaaatgaatttcatactttcttctgcttgaccattctccatattatgatcgcttaaaagcttttcataattcttgtatgttttgaatacattattaaaagcttccttattctgtttctgactattagagatggaagaacaaaaatctaaaatatattttcgctttctttctaggttattatctaataactcagattcaatattctctatacctttggacattttagtaatttctttgtattgccaattatcatgtttttccaatatggctattcttttgtcaatggtttctttatcttcttctgcaccagttttaatgcggaatctatttttaaaatacgatataatttcaataatttctttcgccccaaacaaaattgcaaaaaatcctaaaattaccaacacataattaatttgcgctaaattttctattgcttccatacatacaaattcctccaatctttataataactgaatgaattcagatgcagtaacctttaatccatcatctccgaattttttctttgaagcagtgacaagaccatttccatatgtacctggatattcaactccatttggatcaaaaccattaagatataataatatctcaagcgcagtaaccatattctgtgtttctccttttttaacataatgagagccaagtgctttcctagttgcagaaccaagtttaccatcttcaacaagacctgctttataatctaagttgatggcgtgttgcaatactcttactttcatcatatttgtttctccaccaactaaaccatcggtaacaatttttacacctgtgaatttaatagcttcacgttgaccacgttttactaatttatttccagatgtgacactctggatagttgtgataattgtattctgagatgttttagaaccatctgtatatgcaacaattacatgtttgccaggtgcaacaataatatcaccacattcgatatactctgatttaccaagatattttgatgcttttaattctttaaataatccacttcctactaaagcaccaccaatgttgccagaatatacagcagaagaaatgacaggttttccatatgcaacatttacagcacatgctgctaattcggaacaatcaatttccacaggtgtctttacatttgctacaatccaattaacgttttttaatgcgttatacgatgtagtcctgtgttcctgacaataaccaaaattgttatttaatgcaatagctttggcagccgcaccaatcttaactgcgtattttctatcggcacatctataaactcttgtctgaccaaaattataaatatttccacatttgacttctttgccagtctgatcaccggctttacctccggttgttttaccatattcgtttgcagaagcccatgcacataatacagccataacaaactcctcctttcaaaattattcctttggatttttataagtaagagcagtagtagaatctccaatacctctagtcgtaggatcagtaattgcattaaataaagatactaacgccattacaacgacatatggattacttactgcctgtacaaacgtttcccacacctttgaccaagttgttaagtcggatgcctgtaatccgaaatatgtaagaattggaactacaacagaaataataacctgtgcaataaataaaatattctctttgttaaaacgaactttccagttgattttgttcataaattttcctttccataggagagtagtagcgacctgactattgattacgtaattgttcactcacaggtatgacatctacttttatgctcattgtcttgagtaacctatttattcataatttttccatttcatatatacttctttagtatcatttttaagaaaaatcattacaataatttttctatcatttttaggactataacttggatataaatcaataggatatataccagaatcaatatagaatgtttgctgatctctgttatatatacggataatttctttttcgttataactccttggttttaaattgctttctatagtcattccttctattcctcatataacgtaaaaaatagggaacataaaaccgttgaatagtaattatgttccctatttatatttttcaaaatcactattcaacattaccatcagtcttttcctcgacttccgcaacaatatcatttttaacagattcattatctgttttcttttcttttttatttatagttttctttacctgcgccttcataattgaagcaatagatttctgataactctctccaaaattatccttttttgataaatcaagtttggacagtttctcttttgcttcaatatcagttattcgtccatcttcatacgcagaagcaattctatcaatttcgtgacaattatcactacaccaacaaaagtaccatgttggtttacttttgtcttctggattacatactgggcaaaaactgtatttttttcggcataacatacaggttctcaaatctttattagccattaatcctccttataagagggcagtgattaaactgcccaagcaatcttatttagatatcttcctcttcttcatcaatgtagtaaatagagaaaagttcagaatctgtagaacatgcgttaagcatcatagctcctttgtaatccattgtctgagaatcaccgccctgaagtgcaagagtaaactctggacttggcataaatgatggaatgtgaatgattgcagctctaagagtttctgtatcacatttatcaacaactaatgccttgaaaaataactcatgcgctttcgggaatttcttaccagagttggtaatcttagcaccgctatgaattgtcttcttgtatttaacgatgtactgtgtctctccatctgctgttggtggagttaatacatcgctcgcaggtgtattgtcaggttcaccagatgcatctgtatgtacaatagcaaattctgttgcagtagcagaagtaccttttgtatataattctttacccatagaaccttttggggatagagagtttacgacaacagaaccatctacataaccagtaatatcaagtgtttcacctgcctttacaagctgaatcatcggcataacaatacctttgtcttctgttgcaatctctgcatctgtggctgagatagcttcgacaactgcaagattaagaaatgcattagttgcagttacctcgccttttttacccgtatattttctatatacaaggtttccatccttatcattgatatcagtagaatctgctgtaatatcaatattggcttctgtaagctgagttaaagcatacagaggtgtaccgtttgcttttgcaccgtaaccaaactgaagtctatcaacgattacgtcacctaatttaaatgccatattaattttcctcctttaaaatttgttatttttatgcaataaaaaatgagcgattataaatcactcataaaattaattaagtcatttgggatatcttttgcactaaccatgccgccataaataccatgcatagctgcaacgccctgttcatatttctgtattctttgtacagagtccatgaactgacatatattaacttgttttaaatcatccaacttgtatttaaagccaggatgatttatgcaagcagatacaagaggtaagagagtggaagatcctttcttgtcttcgctctgttgtaccttcattctatcttcttgtaacatccaatgctttgtggttttaccttttgccttttctgttttcggatgaacattcatcattgtacgaatatattccgcaatctctaaatattcatcatcataaataaggatgttcttatcttcgttaaatagcgccaagtggtcatattctgtatcttgtttatttttctttgcgggagttaacacaaatccatcaaaattaaaatctttaaaaattaaatttagtggttctttatcttgtacaagttgatacattatataaaatacttcaatgtctttggttttgttccaatccttgtgaaaagtatcatataagaaaaccctaattgatgttgggttattgagaaaaggtgataaagattgataaaatctagtttccccaacttcaagaatatctccgattgttggtacagaaattgtaatattatttatggtataatcttcaccaaaatacattcttaatttatcaaaatgatattctgattttttattattagatttatttttctcagaatcttgttctgcggcattttgtagattgtctagcgtttctaatacatccatttaatcaccgcctaactccataattggtgatagaagttttaccatcaattgttttgtgaattccattagtatcaacaacttggaatacaagagtacgaacgagatagttattatctgttgtggattctttagaagatatgagatgagtctgcataccaaagatattagaccagttgaatcgttctcttataatagaagcgattaaatcatggcgtggaatacctgtaagtttatcatacctgtcattaccgtgaacaaatattgtaaatgtaatatttgtgtactttaatgtatcttgataacgaggcatttcgtcaaacgctacttgataacatatatagtgttttacttctgtctgagtgtcaggaataaataaaaaaggacgaatgtttgaattactaccaaagtaccgttcccattcgcctaatggctcatattcacctatttcattattccactcccagtttacattgccatcatcatcaaaaagttccgtttctaaacttttttcattgagggcatataataagtctggacgagttaataaagctttttcaattttcttcttatattgaatgttttcatcatcaggagctgatttatactctttaattttatttaatagatcaatttttgtaattatcttttccgttattttcacctcctaatctgctaattccaacgcaagagtttcagattcaattattacaccatctttttcaatagtgcatttaacagacaatattttgccaatagtagaagaatcactagtaaactttactttcttttggttgtactctgtaccagctcgccatgatactttatctgtccaatcttcattatcaatagagcaagtccatgtaaaggttgcatcagcatattcagttgtaatatcttcattggaatcattgaatagatttactgtaagatttttataagagccaccgaccttgattgttgaggtggacgctgaaattcttgttgtgatagaagatgggggagtggttggagtagatggatctgttggggcgatttctgaatcgaaatagtttgcatacatttcgcctgtttcaaaattgacataatcagtatgctcgttaaagaaattggtgtacaatgtaagtttttgtagcccaagtggagaagccgattcacattttgtaattttccacaccgtaggattctccatcaaagcactaacaattactcgcatattctttgaatcatcgtccgtataccagaatttttctgtgatagaattcatcggcagtatcaacttattttggttatccgtatgcccaaatacacggtcagtataaacccctgatgtgtaagacatttgttgtcttaaaacacaccacattctacgcttgatacgtttttcattatttttttccacccacataagttcatagttggctggcaaaatcagatactttgggaattgatttgcaggttcatttctacaaattaaccatttatgatatacccctctatcgtcaggtaaatccacccagagtcctatcggaaatgtcgcagaatagcgtttcctaaaatcagtctcataataataaagatcatcaccttcattgaatcttacaggctgacttggacgaaacataagatagtattctacttgatctttatccattgactgataagatttgataataaactttgcatcaatttttgtcttattggtattttcataagtcataccttcagcaagtgaacgtgtgattccatgttcgtctgtgaagaagtcatcatgaaaatggtcataaatgtaacaggtcgtggaagtaatactgttatcccaagtttcttccatcaaaaaatcagattcttctttataaatctgacctaaagttttcgcattatttgttttggcgttagcgattcgccgtgctgtctgtaagcttggcatcaccaacacctccttcaaacatctgcttaatgtaattgtgactatctaaaatagccctacgaaatgtcatgtaatcaaactcatcggatgtaacttcgtcataagcggcttgcaaagtagccattagtgtgaccataattccattgttattaaatagagtctttgttccactaaatttaaacataacattgtggaaaaatataagaaaagcttcatcattctcaaatattttttcttctatttgattatccttataaagtaataacttatggacatcgttgtgcattgcatgtgcagcttctttaatttgccttttagtgaacgaaccatatatatattccatagttattcacctcgcacatatgaattattaatatatccatgacttgcaagttttctactaaattcatgctgtaatgtatctaatctactttgcatatctttatatggattctgcatgtttttttcttcttttgttcctaagactctagcagtaaattttgcagagtcaacctgtggttttaaccattcaattgtcattccaagagtgaacaatcctataacatattccttatctgcaaaatcgctaacaggatattgcatctcaaattcaatctgttccattccgtcatccatattaaatgaagcgaatttcctaataactcgttcatcacctgcaaccatgtgtaagcgttcagtccatgtttcattaagatcgttttcgtcaagagaaagttctttcatatctgaaatacgtcctcttgttcgtgaaaaaattgtttcatatggaagcgtcattgtgagcctcctttactacatattcaattttaaaagtaactctgttccaaaaatagaatcaagcgtctgaattctcttaacagaatcaagtgttccgtcatcaaccatacttgttgcaatagtttttaatgcttcctgtgctccaattggaagagaatagattgctttttccatttgcgaaggagtcatctttaaaatatctcttaaatcatttgtcgagtgaagagtagaatataaatcatcaagttctggatgtaatgcgataaaatccgcatcctgtacaacaaaacgaggtttaaacatcatcttgtcacccttccttgctgcataatccaaatctctaaattcaatttcctgaacgtcatcaatatctgcaaatgtatataaagtatctgatttaagtccaacataaaataattctcctgcggtaagagacacacatggaatcatttctgttggctcaaacttctttttttctgatttcttttcagccacatcagtattagtattttctattgcttttgtggtggtcttttttgtatatgccatttatttttcctttctatccaatataaaaaagagtggctagataaactaaccactcaaccttatttactattcaagagtccactgaccaaagtactgtggtaatactacctcaacacccatttctctctgaacttcatatttctggaagtcatcagcgtgttcacccttctgagtaccagactcataaatctgagtttcacccttatctgtaaaccacacgaactgttcctgattctttgcaaagataagaagtctcttatcgtcaataagtctctttgttacatcattgaaagcaaatctctgaggaatctcaataagttctgttccttcgtatgtaccgaggcgaccagtctttgcaacatcctctttctgagacaaacttctccaatcaacttctgtaagaccattaagtttcttcaatgcagtctttgtacccataataacaacttctgcactattagcagttccaacatcctcaagaagtgtatcaaacttgtccttagtagaagcagataaagcacctgtttttacaaactgagagttgttaggtaacttagttgcagcaccataaattcctgtatagcaaagttcctgaactttatatacaaacgcttctgcaatcttatctgtcagctcagtaaaatcaatacgtccaagtaaaataagatcaatatccttaccaatctttacaccatacttcttagtatgaatcttgtgtgctataccttcatttaagtactgtaaagtcagatcatggtggtcaccactaatttcagcaacagcaagcataaccttttctcttgaccaaaactcttcctcgtcgccaagtttaacatttctcatatctacaaaatcattaaaccactcagattccttgaatgctgtatctaccttaaaatcaatatcagactcaagtaactcatatacttctgtgtgatgaagctctaaggctctttcacgtctcttattggatctaagatcctcttcagtaaggtcgcatacctccataataattttacggattgccttatttgcttcatgtttagaaacctttctctggtttccgtcatcatcgtactcataaatatcaattccgtgatttaagttatatgtaagcttcttaaaattttcatacttatcagcatcttcaaaaacttttcttaaatgttctgtactaaatctcatcattattctatatcctcctttctattacgcaccaatttttaattttccactagaaatcgttgtgatttcagctccaactgtaggtgagccatcaaaattatcttctgtaagccaataacgatcctgtgaatgaagcatgtatccacgaactgcaccgtctgctggatcgttatagaaattagaagcaagtgcgagtgaacgaggactctcgacattgttgagaggtttctgatagataacaccaaccccctttggatctctaattacaacaaggtatcttcctgacgcatctttcattgcgatataagcatcaatttcagttgcagcttccatctcccaattatcaagagaagtcatcttacctggtttgaaatgatatccattaggtgtatcttctgtaatctttacagataaaatgtgctcgccataatcctgagcaagtaaattaccaatttccatctgtggaaattttgtagcagcatatttaatagccattatgttttcctccttaagttttgttttttttgcaataaaaaagaacgcataaagcgttctatatgaaatgaagttatattcagttttttaatcaaataagttgccgtagtttttcttaggctttgatttcttattcatatttgtaagtatcttaaccgaatttgtgtttttctttgtgtcaacagaagagaagttcgcatgtgcagacatataatctgaatgcataacctttacttttgtttcaaagtcttctacggaataattatccatagtctttactaattcagcgaaatcagtatttacataatttccttctgaatctttctctgtaagaacagaatagttatcagcattgataatagcttctttttgtgcatgaagttcattcttttctgttgtttctttgaactccttaagggcggcgtaattagaacgcatatcctcaatagaaagcttctctgattcagtaagtaacatagcaaacatttcaattctttcaccagataatgaaatattatcaccatctttttcataggactgtttataatacttgtcgctgtcccaatcctccataatgaaataattttcataaacctgagatacataacaccattctgaatcatttctataaactgagcacaaattatttaatgcatatctgatttcatcaaatgaaatttcaaataacttattaaacagttcattttttgaaatgtttccaccttcgttaccatctggatcagaagctccttctccatcattggaaggctcaccagattctccgttatctgaattgtctccgtctgaattatcatcatcgaacatctcagcgaattttgcttcaagttcctcatctgacatttctgtatagtcaaatgttacatcttcaacagttttaccatacttggcaagtaactcttcaaattttgtcattttgttatttgttcctccttcctttgattgtgtttgaacaggagtctgttctttattgaaattagaaagtgtcttgttaagattttctaagagttcaatcattttttcatctttatcaaattttactgaattgttatttacactaaaatctgcaatatcggcacgagagccttccatgccttcctgaatttctgtaccatcatcatgacttcctaacaaagtcgaagcatttacatagaaatcgtttaattcaagatacttctccttggcgttataggagagttcatcaataaaaagctcgcaactattttttgaaccttgtttggcacgaataatctcacaagcctttgtatattcttcacttatataagcataagcacatacataatctttatctaaattatcatcatgttcccaaaatgcaggttcagatgagaaagagccaacttgagattcaatatatctaagttcttcattacctttttcgtctttaacaatttccatctcatgaccttcgaaatcccaagttccgtctgcaagctgatggatcgccgccaacacaggtctgtcagcaattgtattcattgctttctcagcagcttcttttgatacataactcttatttctgttaagtcctgtatgaaaaattctgaattttagacgcatcattccacgatgattttcgtctacagtataatctacctcgaaagtagtaggtacttttaaagccaaccgatagccagtatctttagaactgaattttgcaaatttctgttcttggcaaaattttagtaaatcatcttcagttaaaattttctttttaataacctttggcatctacttagtcttttcctcctttctccaaaataaaagtcgcccaaggaagacgactaaaatgtaagcatatttgtatacttcaatttatttatatctatattttctgaaaaccgaagggtatcagtattcaaaaatacataaataccattagaattttgcacctgttgatatcctaattgagatagaagagtagcagtaggtacatcttgtgtctgtataaatttttgattcattccaccaactcctatttatcatttaaattctcgtctctggtgcgaagtccagcatctgtaagttccgaatcatccttctcttgacctccacctttatcattgcctgtctgagtataagtgctagataaaggtttaaattttgaactaagctgcaaacagtcttcttccaaaaagttcatagataacgtatctttttcagatacgccatttaatgtgttataaagaattttgtttggtaatccattagtacacgattccaagattgattttctaaaatcatccttctgataaatagaaacatcaaagaatttaaccttacaaggttcagaaatccaattagatagaagtcgatttacaatcgcttgaatctgtggaataagagttgaaatagaaaatgtagaatctgcaagtacaccatatttaaaagcagtagaattcgatgcagagtttaaatttaatatctgagcaccaccagccgtattgagaatttcttttgtagctttttcaacctttgtaacatcacctgttgcatcatctggaaaactaatttcatgtaattcgccaggaacaatagcagcggagatataaggcggtaatgcttcttcaagcatacgattaaaatactgaatcattatatctggattcacagcccagtcatctacatcatttcccattgttttcatttcaagccatactaacttataaatattagccgcctgttgaactgcctgataatcagaagcatccataagatcaatcaatgataagaatataggtgtaagcacaggaacgattgtttcccagtcttcagacctaaatttaatacatacattgtattcttcgggaattaactgatatttttcatttgtactctgatatgtattccacatactattgaatggttctccccaatattcaagaagttcctgatgactacggaaataactcatatccatagctcctgcaaatgaaccgtcaggaaacatacctgcaattttcatataatctggatctaatggaagaacaaacattccttgtccttctgtataataagcacatccataaaatacatcttctcttaaagtgatagacgcagctttacgaaattcataattcaatcctaaagtatcaactatattaactgtttcttgatacttttgtaatgtggattgtacatcattttcgcctgagattataaatgggggaacaatattacgaattgtaagatcaatctgatttgcataatatttacaaagacgataatagatttctgaacgataataaagataacgagataagcttcgtagattcttttcattagaagagatattctttatgtatgattttacatcttcctttgaatagttactgattgacgtatatctggatgatttctgaatatctcgaagacttgtaattgcacttgttgcgtcttcataacgttcaagtctacttttatttttctcataccattcacgcatttcatttgcggttggctgttttggagtagaagaagtggttttcttctgcgaattatttattttagcaggtgcattagaatttgcatctactttcttaggtctaggcatgtttgataatgcacctccttaattgtattttgctttacggattgtaagcttattaatgaaacttgtagcatcttcttgtggtcttctttgtcttacttgatcttgacttcttaatgtaaataaggcgtgtcccattaaagcgagacagtacgatctatcatcatgaagaatgttctcaaaaccaggagcaagatcatatctaatatttccattagaagatttgtatttgtacatgtgagttaattcttccttcatggcatcaagctgtttaagaccaatttcttcttcaagagataatttataattcttttcaacaacctcaccattttcttcttcaagcatagtaagatttccatgataatcatactcagcagtaaaactaatcaagtcttgatcaatcatctcgcataactgtgaatacataattgccttatatttagctggctcacgcatacgaataatatcaatagcgtctggatatctttttacatatggaacagcataatcataattcgcatcaatcaatccatgatgttcataatctttttcgcctttatgctttgcttcatagaaattatcaaaaagtagatcacatatctgcgtcgctccaccaccagaacctgcgtcaatgtatactccatgaatatttttataatcaggaacaccgtatccgttatatctgactatgatatcttgaagcattgttacctgttcaggggtagtaagtggtttttgtgtttctttatcaatcaaattgataccatttacaacgtctaataaccaaccacgcttatcatctctatgtaatttaccaaccaacacaaagctattatctctttttttggcaggatcaaaacagatgaccataagagaattatcatcattaacaagcattggcggtctaacaacgctatttctaagcacttgtgatttcttaactgctatatcatcaccaaggtctgaatcaaatttattcatatactcacgagtagccttagttggattcatcttcatttctgaatcaatctttgcttgagtaagtagtggaacgggatatacttttccattataagtagcatgaagaattacttcacaatctatatctgcacagaaataattcttatcacctgccatagagtgcattgcagcttctttatatcttttataaaagacatcatccatagaacctgctgaacttgcacatacaacttgatttgggaaatttggtggaagtaatgttacatcaacatcaccaccaagagcaaagtcactgttctgagtgacgaacggaagagtagcagcgaacatatcttcagatacatacgatgcttcatcatagaaattaagtcggcttcttcgaccacgagatccatcaaaatttgagttgaccgtagccaaactcgatcctgaataaagtttaaaggagtaagatgctggatcgtgccgaaatccctcactatttgaacttttaacaagttcgtttagaaatacatctgtcaagccagtaaatgaagcgatttcttttttggcaatagattcaatcttcttcatcatacctatactttgagaacctgtgcttgataaaatgtacccttcaaattttggcagtaacattgttttagccatcaaaaatgggctacctagagttgtcttaccagcattacgactcatacaccaaacaacatttggtgtaatccatgacatcataaatacatatttctgataatcaagaaattcgatgccgaaaaatctttcacagaattttactgggtttctgcgtccccactgaattatttcagagaattttttcaaaccctctaactttaattcagacatatcataataagtaggttttttgaaaaaagtaaaattctttggagtaaattcatttatagaatcacccatcaggacaattttatcatcagccatcttcgattacttgccctttctcatctataagacctttttcaaataagaaatctttaaggtctttattttcctttttcaataacctactaaattcaactgcattatctctttctttttgaagattaaataacaatcctttttgatgaataacttctttttcccaatcgttttcatcaggatttaactgttttaattggttctgatgatttcttgtcataatatcttcgattgccatattagtttcataatcgaaggtatttacctcagaaccatctaaatccatttcttgtaattcttttatgataccagtaagagtaccagcacctttactttttctattattattattttcagatattccgttatcctttgctagtgcaagggcagaagaaagcatatctttttttgtctgtgtgagagattttacggtggcaatcatttctggatgagtttgtagttgttttgtatactgagccaatgtgtcatttatatgttttacatctttaaacgactgtactatttcaattacagcttccaatttaaaaccatcatcttttaatgaatcatcaaaataattcaccaacttactatataaaagaggtttgtcttcttcctcttcatatataaaaggatcataaccaagcattctaagaacacttcgtttatttttaacatacatatcttcaacatcttcggatacttgctgtggtttcttttcaaaattttccgcaacatcagttgtcacatcattaacatttttctcaccaaaatcagattggtcaaacgtcattccaaaatattgaggtaaactttgcaaacatgtaatcatttgactatatccagtaccacgcttcttgccactcacctcattcgtaatagcactacaagagttatcatataaatcttctaaaaatggtaaatcagcttttttcattgcctcaataacagtctctcttgtttcgtgtgtttctttggttttttcatcatatcctgttcctattttataaagacattctttacaaacaggaataagacctgatgcattttttggactcttataaaatttatcacgccctttgaattttccgcattcatggcaataagcaccatcttttattttttgatactcattgaccaattttttataagcagagcgacattgtgtaacagtcatcttgcttacatcttcgatttcatattctttgactcttggcacaaagtcacttcctttctttccaataaaatagaagagtaagtttaagcaaccgactcttcttcataatatttccatataaaattatgacttgtggtagttcttcctttacaattattaataattgtacctctatcataacctaattcattatgtatatcagttattgaattccatatttttataacattcatatctaaatcatattgaataatttttttcttaatatgagacatttgtttttctctttttaataaaccttctttttctccattttcatataaatatgccttatttttatacttaaatataaaattatgtatagaccttctttcgccaatacaacatagatatatatcatatgttctaagatttgatattaatgattcatcataaatacttttagaagaacgaatataattaccatttgaatcaaacacatcaacaggttcacaatatatatttgctttacttttatatttaagcaatatttcatttaacttatcaatatctttatcatataaccaaatgctattttcataataatctttttggaaatcacaacacttgaaaatggcgttgtttctataatttgatgcatttaattcatcaaatgtccatattttcagcaaatctcctttaaaattatattgatgatattttgtatatttgtgataaacgtcagaatttaatgaataagaagacgtttctaaattcttatagtcttcttcataaaaccataaactgtcataagcaaaatgactttctgaatttagagcagtgtatattcctgcaatagaaagatttaatgttttacctgccttattcttggaatcccaatttacaattgaattgtctaacaaattaatttgaacaagcggtctttttaaagcattgtgtgcctgagataatttttctcttgctttaggattcttcattctatctttttgaagtttactcattttttcaatattttcttctgtatgagtatatcccaaaccgccagttccaccttcgttcatgttgtatccgtttttaaatgaatcataatatcttacccaataacgctctctttggtatgctatatcatcatttttgcatttttctacaatttcaaatataaaattttcttcaccatatttattccatgctctttgaagatgtttattgtggtgaacacctttatttaaatcttttctatgctcatcccatctaacataaatattatcagattttccaatatattttttattattcaatttgttggttattgaataaactccacatattatctcataatctttaggtgtaaatcttttactcataacatttctcgctttccacccgcaaaaccaattaaaatagagtgagagagtagtacgagtatctactatacctaagatgatcagtcaaagggttctcactccataattccaactacctgccatcgaaacagtaacaatcctctcatagttggctatatatttattctctttttaaatacaaaaagagaccagtattattactgatctctttcaaataatctttacaatattttttacaagttgtcacgtaattcttttgctttgtctgcaatccatgttccaggaaaagcgttcattatttctcccaataaaccatatgcagttgcagaattagaaatttctccatcttcaattttttcaataatttcttcggcagaagccatatctgtaaaattccacgccataatattcacctccatataacaattattgcatgttagataaacaaaagcaacatagaattatattgaaagtgcatttatttagaacgccgtgttagggattcgaaccccaaagacttttacatccagactgttttcaagacagcaccctcgaccaatcggacacacggcataagcgcagtatataggactcgaacctatgcaccgaataaacgatgacctctgattagcaatcaggtgcaataccaactctgccaatactacataacaaaagagccatctctcatgaaatgactctttcttaaaaaattatctttctctaaactaaatgaaactattttcattatggattgtcaacactttttcagacaaatttttttaggttatttttccgatattgtacaggcgtttgataccctaaggaagaatgtatgcggtgatgattataccagtttacataatcccatagttttatattcagttcttcctgcgtatggaatgtttcattccatacaaattctgtttttataatcttgaacgtagcttctgccactgcattgtcataaggacatcccttatggctcagggagcgttccatatggaacgtttctaacagttcttcaattgtctcgtttttaaattcatttccacggtctgtgtggaaaatatggatttccgacagatttccgtctactttcataaatgcctgttttacaagttctgctgttttatgttctcctgcactgtatccaataatctccctgttaaaaagatcaatcagtacacaaatataattccagcggtttcctacccttacgtaggtcaaatcacttaccactacattgcggtatggctggttttgaaattgtcggttcaacacattctctacttttgattcattacatctgtctttttgcggtttaaactgtgctgtagtatagcttgataccagaccttcctgtttcataatccgtccaatcctgcgtcttgatacctgtttcccgcaatcagccagttctttcttgatctttcgtgtaccataatggttccggctttttctaaaaatttcctgaatgtctgcagtgagttctgattcatctttttttgctgctgcttcataataataggtgcttctgtttacctgtaggacgcgacacattgctgatacagagtatttgtgggcatttgctttaatcacatttactttcgtcctaagatcagcgccgcttgttttaaaatatcattttccattcttaactgctggttttctttccgaagccggatcagttcttcctgctccggagtccggttatctttttcatggaaagaaccggaattggatgcctgctttacccacttgtcaaacagggaagtagcaatgtcatattcacggcagatatcacatctgcgtttgccggaacgatatagttccaccagttgctgtttaaattcatctgtatatttgcgaggttttcgtcgttgtttttgttcggtcataaagagtgctccttcgtgtatttattatagattatatgaccttaaaaaatctgtccagttaattgtaacctatccattacgactttatcagaataatctgcgtagttgttgcctacggataatttgatagggcggtagtaagtgttgagcttacacacctaagtttcgtatgcatccaaaaaataggtttttacatcaggcttaccgcacataatctggatagcaggactcgaacctacaacgtctagttcccaaaactagcggactaccaaattgtcctatatccagttgatagggtgggaagtaccacccattatttttactcagaccaaacaagatctgttgtataagccaatgtattaatcggagtaaattctgttaccttgtaagaagctaaaagctcaatacatttcttctctaattcatctttattttctgtagaatattcaacagtttcatattcgccagtcccaaccaatgtagtaacttcttttacttcatgggtatcttcatcggttacagtttctttctgttctttcataatttcctgctttacagtaagataacgatacattcctgttttggaatctttaataagaattttatacatagtcagcctccttacagtacaacagatgtttcagcttcaaaatcatttgccaacgctctgatttctgttaattttgttgtgattgcagctttcactttttccaagaaaagaactgccattgcctgtcctaatttttcagaagtattaaacactgtaccaagagaagcagtaggaattttatttatgtcaatagaaagtgtaatagataaattctcatcgagagtgtactttttatttactaaatcagaaattgtgaccttttcaatagtagaaccgtctggctcatcagtaacaatcacaggaattcctgtatctgaaagtttcaaatttccagagaagtcaatctggctatattcgatatatcttacgaaattatgtaactgatttttctctgtatcagcatctcttatactatcacccaattcttcgacatttaaacttactgtaattacatcttcgttaatttctgttttctgtgctaatttcattattcagtttcctcctcacttaataagttataaaattcttttaatccgcaaatcatatttttaatggtagactttgacaaattacactgtaattgtggtaaattcatatctgtatcatttactttaaaaacaagacaattgttatcaaaatcaatactcatacttgcttttgtctgatttccaataagcatctgtaaagcttttaaagttttacaattatcacttgtaatacttaatacgtcaccaatttccaagtcgttttcagtaacttgtaaataagccattatatgtacactcctttcttttattttttcgttttccttttaatctaactggggtagtaggattcgaacctactaatttagcagtcaaagtgctatgtcttaccgcttgacgataccccaatgttgtatttttcgtaacctttacagagtgctttaaaaaatataaagtcaagtatctctaacgaatcgtatgggacttgaacccatgttattctaccgtgacagggtagtgccataaccaactaggcgaacgatccataaaaaatcagcataaagcactaactagctgatattggactgtacacatccagttttaaattagaaaactttcgcaatccattcatgcttattgattattctccacatattttcagtcttcggagcaaagaccagttgataaggttttgcatctcttatccaatagaccgcccagcagtcattcactaatggttctcattaacgcagagaagcacgatagatataccgcattaaggtttcgtgcgcactagagttgctataaagtcagctctaccaaaatacagtagcaggtcttacaatgctacatgaatagcaaatgccaagatatgacatggtgtgcctcgaagagggctattaagaatctagcttcgatatttggacactatattattctctgttttgtcgcccacttaagggttcttttatttgttctcttgtttggaatattttgacatgaattgtcatgatatgatataatggctagaacaagcaaataatccaacattttaatttggctagattgagatggttaggcggtttgagtcacatcagaacagtgatgttctgtttatatagatatcctcgtgacatcatgtaggaaatacttacaaaggaggatataacgtgacgtttattgaattattaatctttacgattgtaactggcatcgtaagtggcgtacttgctacatacttagtcagatttttcgatagacacaaaaatgaccgccactcgccaaagcacggtcattaatgtgttaagtattaaatttatttagcctttattgattttacatttggctcaaccgtctaacggatatttgcttgttttctttagaaattattctatcacagttttgtgttgagtgcaagggggaattagacgaagtgttagacgaaagcttcatcgggattgcttaaataccttctttttcagcttctttctgtaattcttgttgtttaaactttagaatttttaatttttcccttaaatcagccttagaagcaggacgtacatagctttgtgaagttactgaagttgatttgtgattcgcccattgtgatgcaagatttaaatcaccagtatcttcatatattttattgatcgccgtcttcctgatgcaatgacaatgaaagtcctctaagccaataattctaccgatttttctcattcgatcgtgaatcataccttgtgtccaaggaatccatttgtccttatatttatgaataaatagagcatcgcattcaagatggtcataatcatttgttctcatagataaccatgtttcaagcatatccttacaggtactgtcaaaggagacttctacacggtatccttccttctcacgtattgactcaaataccatattgtctaagtcaagagaagatacagtaagtttctccaaagcaccaattctattagcggagaagagtgcgatttcaaataataactgatcttgtattgtccatttgttattctctgtcttatataaatctgctctaatagctgcaatctgctcatcatttaaaaagtaatgattaagaatctgttcttcgtttgcttttttcattctatcaagcttaccatcaaaaggatgatatttaacaaatccacgcttcatagaccaaatatagaatgaacttacagcagaaattttcatattgattatcttcttatgattcattaatgtttcctgacagaaaagcatatatgcttccataatatcaacggcattttccatgaattcatcagaatataaatctaattcaccataattttctcctaaccacatgaggaagtgtcgaaacaatcctttatatctcttgtatgtagtatcttttacatcacgatttttgatgatattagattgtaaatatttttcatatttcttccaattctcttcataaataaatttctctttatcaggagtgaaatatttcacccttgttattttctcttttgacaatatttcagcctccttttttagttaattattttattagtgggcagggtgtgatttgaacacacaatgtttaccatgtaggtcacggttttacagaccgcttgcttcagccatttgcatacctacccatataaaaagagtgtgcagcatacaccacacactccaagttcaaatgttatttgaaatcagcaaatttgtctcttaaacacttacacactgattcttctataacatatcctataatctaaaatctaaaatccaaaagcctttaacatcttctgaatatcttcatgacttaactcatcgctagagtagtaagaataactcatataagagtcgccatctgacttactagcagtaaatccgtgagtatttccatattcgtcttcagaagtatgtaaataagtctcatcatgcacatggcagttcttacaatcaccatcgcagtcatcttcctgaccaaacagaataacttccttatcctcatttacacaataatcaatgatattctgctcgatatcaccatccatatcaatatagaaaatatctgttttatcaagaacaccaaagtcctcaataggaacaacggtgattacaccaccatcatcaacagatacaagatattcattgacttccatataatcaacaagatcaatctctttaatacttgtctcgtcaagtctaataagattatccaaaatatattcagcaatttctttatttacaattacaccaactgttttatcagtataatataatctattgatataaatagagataatgtcatcaactttatcctcaagatcaatcatctgaatgtcttcatatttatttttcttcaaacaattcacgacctttcagattagagctgctttgcagtctttgacatcttaaatgtgatctcgtcatgctgtggagttacatattcctcacccttgcgatcacccatcataatttttcctctacgctctggagctgtcttaactttaaatttaccaagcttaccaactgcaactgattctgcgtggtttgctgttaatgtctctgtgattacatcagcaaaagcatcaagaataactgcgatgtccttctgtgaagctccctcaactttatttgctactgcctttaatacctcgttctttttcattttaattttctccttttctcaaccatttgttattttttaatacaaaagatggtagcgtctcctttgagtgcactccctctgatacatacaattgtgacagtaacatcacaatttctatacaatcggactaatttaaagtagaaaattagcccaattttcatagttacttatgcataatataaaaaccaagtcactcgtacttggtctactttgtcatgaaattagtaataattcttgtcttggaatcaataatgttaccatctgaatccaatgcaagatacataaacccgttctgatttggaattataagtttaccgttgttataatctagcttatccaaatcacacacgcaaccttgctcatacatttttattccaccttgagtaaaacttcctactttatgggtatgagccattacgattccagtaaatgtgcgatctacacgcaagaaataattaactgccttttctgttgtttttaacatgccagatgaataatttaatgggtgacagaaaattacattaccttcttttatccaccattctttatcataaacgatttcaatattcgaatcttcaaacacttcacgaatagaagagtattgtgtctgggttttatttctttcatcattaactttgaatccatcgtctacaatcattcctagcggatctgttgggattatgccaagtaattcatttgataatctatcagaacagtatctttgcatacggtattcatgatttcccatcacaaacattacctttttaggtgtagtcagattgattaaatcaataatatactgtcttcctaaaacaagttcttcatcaagatttactttgaattttttaggaaacgcagaacatgaaaaacaatccaataaatcaccattgactattaaagtgtctacaattcccttatagcttgcaaaaatatcaataggtaaattaaacggaatatgaacatctgacacacataaaattcttttagatgcaccctcgcagttgtgaatataattatcatactcttcatatccaacagcctgttttctaagctgatctggtgtaatgttcaatccaagcatatctcgaatctcaatccaatccatatctgtttccttgcgcttttttgcaagacaacatctcaatttccattcaaaatctgtttcattttccaatctatgtaagtcgattataacatccacctactctctattcagcagattcagactcttcatctgaaatctcaatactgattttaatatcaaagatagttgtaccttctggtaatttctctgcaatacgctctacaatagaaccttcatcgtcaacgaaagttccattttcaattcttactccacttgctgtaatattctttttagccgcactaacagttgctttcttaattttactatctaccataatcctttaaatcctccataaaattaaaaattcccaccagaacgttttctgccaggattgtaatatacttgttttcttttattctgttttacttcaatatactcacgaatcttcctaatataattttcatcataactcaaacgaatatgtgattccaaataataacatccacaacgagttggaattttatttgataatacattgtctatgagcctatacgatggattaagattcgagagatgggtatgcttttctgtatcttcttgtctacagatacgatagccattttcagtcttgtctatataaaaacctttatatttaattctatttttcataggcagaacctacttgacaaatttatcttcgatgtaacgctttttagcaacacctttagtacgataataaccgactgaatttccatttttgtcgatatatcctcgtcttgtgtttctgattacaccttcggataatagcttttcaatttcattttttgaaatgtacttaataattttcccttctttcttgatttatttcctgctgagtagcagaagagtagcaacggcaagatttgaacttgcgaccttcagattattactctggcgagatagaccaaacttctccacgttgcgataatagagaacaatcggcaaccatgctgcaagaattgtagcacagtcaccgacacatataagaagaggagtacaatatgaatatgtaccaatcttagaaatgatttttagaattgttctgtttgaaaacgcctcgaatcgttccccataggtttgattcctatatatcttccacagaaatgtatggtacagtctcgcttgctgaacttaactggttttgcacaccatacacaagtttttcacatggcttcacagcaactaaaatatatccatatgttagacgaaatattataatgtctatcgacaattatatattctctgttttatcagccaagaaaagctgatttcattgttttatattcggggcagataatgatacgtctgcccctagtatactttttaaacttgcaagcccttatttattacacgcattggcaatggcgtgggagtttactaacgcaactctgcggtttcttccctccatattacggacgttaagttgaacgctaaaagccttgattttactatgtttttggtaaaattgcacaattagttgccgaaaaaattatacacatttatcactattgaaacttagcataaacttttctttgttggttttatacaatagattgagaatttttcttgtatatttttcaggcgaatacttcctccttttagatgccccctcttcattgcttaaaccaagtgctatctcaatcagtctatttattgtaattatattacctattttaattttctttattgattcagttacttcttttgatttttcacaaatctgtttattatactcttcatcatcatctatatattttaattttgtattttttacaaaagagtcatattcctgaactaattgcataatttttgtcatttgtttatcattagccttccccttcattttaataaaaaaagattcggttgataatgtatccgaagtagaggcgttttgaattttatttatccaatcttcaagccaattcataggacataacaattctctattaatacgacttttaagtttgttttttgattcatcaacttcctcttgcggaagttctttaccatctttggtatatttaatttctcttgtgtatttcataaactcagggaaatcgtgtttcttatactttggtttaccagattcagtataaccgacaatctttttaatactcatacaagagagtttgctaattctatcaatttccttattaccatcaatttcatattctcttttacatccatcaataataacctgtgcaagaacagacaaaatgataaaattatcatagagttctttaagttttttctcatcaggactatctttttgtaattctgtccaataataggtcattgccaactgagccaaattacttgaatatccgattcccatacgtgattttgaaaacttattatccatagcagcataatctttttttgtgttattgtaggtaataccagactcttgtaatgcatttacgatagtataaaaatctctataacatctttctgcacatttgacaattgttgattgatttgtgacaagcataaaatccgagtcttcatccatcccatttgctctatcttggatatccgtatgaatacaattaactgctatgatatttttactaaatgcaaaatacttatccattttttctgaatagacattatgcaaataacatatattatttggggaattatgtgggtttctaaacgctgcaagatattcattgttatcgaaacgtttagtataacactgaatacaattatattcttgagaaagtgttggatctttttcaaaatcttcaccaacagaatagagcagaagtgcataaggattaccacatacagtcaaattatcaccattgaccataatttttccttttctcattctgtatacataatcaaagatgattttctttttttcttctctaaaaaatgtactatttccaaactcatgattttgagcatataaatcggcaagcatctcataatgatttacctcatttgcattctttctaagaaacttttcaaattcatcattatcacgcttaagtaattcaacataatcaatgctaatctgagcaatatcttttacattatccttcgtacatggaagagtattaatcatctgataactcaactgttgatattgtcctaatttactagggtggtcagtttttacaatgccccacatatcaccatcagaatgaattctttcgcaccaatagtcatatgcttcagtaatattattacccattaagtcttgaaatttcttccatttaatcgcattatcagtggttatcatcttaatatcttttaaataatgccatttaccaaacatatcttgaacctggtatgtattgtaattatatccatttttatcacaccaatctttaaagaatttttgaagataactcttaaaagcacatgctttaaaaaggtgatttctgagtaatgccattccgttaatatacgatgggagacgaagataattataatcagcttcgattagtgccataccatcccaaattatatttttgacttgacgtttttcttcggatacaacacattttttacgtttttcaattaccttttcgtttttgttagtttctttatttttctttttgacttctacttcgtattcttctgctttaacaacttttgtcattgtttcaaaaaaggaatcctgatctttgagaattagaatatcctcaacaggtatatgaagtgtaccaataatggtagatgtggtaagtggagcataggctgacatttcaacgattttcgcattgtcatgactcattttttttccaagtccaattgttaaccaatcatatgcaatgtcatataatttactatttatgaaaataacttgtccaagtttagctttggcacttgtacgaaaaagcatctcataatgaattgtttcttctttaattgttccgtctctgcgtttacgtttatatgtaacattaacaccattctcataaaaaaactctcgaatttcatctcgtgatttttcatcatacagatcttttctatcttcaactttttgtaatgcctgtttaatacgttccttagaatcaccatcagtatcattaaataacttttctaatcgagtatgctcattatcataagagcgacttccaaattcataatcaagacaaattatatctcgtgtactttcattttttttaccagattttcctttataaatatttaatccgttcttttgcaagaaaaaactaaataaactgttgttaaacatagcatcagtatatgtaaaataatctcgtgttccaagattaacatcatacaacataccagcactaatattttttattttaattccatattcactcattcagtatatcatcaccgccttaacctaaattctcccaaaattcatcttcagaatcatagccaccataatctaaactctctgcaaactcatgagatgattttgtagaagctttgtaataacattgctccaattcagaacattcttcacatctgaaattattgtcaaattcacattccgaaagttcatctacaattaactccttcatttctccaacattgtcaaaattattattcatataaaattacctccacttatatattctccaaatgaaatttctatttactttacaaaactaaataatttgaataatcttttcgtgtttattttcttcatttctgtctcttccttctgcattctttctacattgcttatcaaaagcaaaatctctaaaaattcgatctgcgacagaagatgctttatcttttcgagggtaatctgtacagaaatcatattctgtgattagtcctccgtatgtatttgcgtgtttatgattctttggtgtaattgttacggttctgttcatttaatggttctcctttactgtttaaaaatttattcattgcaatcagctcctttgagtgctgcgtttatagttcctatattttattattctccaaaagctctatctgtttttttatttctttatctgaactatattctttatcaattctttgtccatgttcatcgtgaataaaatgcctataatcagcaaatacctttggggtagtagcgtatttttctttaccatccttaatatatttttctctcttcataggctgacatttcacaatttttagtacttccaaaatatcaactatgcgactaatatatctctcagaaagtccaatatcttctgaaatagtcttaaaatatctataacaacatagtggcttatcatccattcggttcaaattaacacgaatataagaaagtacaagtagaatataagctgatgatattcttgcaggatcaatctctttatcctttaattcatctttgaaatttaatattgcatctaactcatcaaaataaatgattccaaacttgtcaggtacatcgaatttttctatattaagttttacttgctgatatttgaccgaattggtcttttcttttagacatttctcaaaatctggacacgattcaaagtatccataatgagagagaagtaatagaacttcataatatttctgatttatctttccatctctgtagttaggtttcaatttagaccagtggcaaagttctgttgtagaaaatgccactgtgtcatcaagtgaacgccttgcacaaagatatgagaagattattacacgtttagacgagagttctttatcataaatgatttctcgtggaatttttacatagtttggcaagacgtatcacctcactatgctacaaataactcacaagcaattctaagcaatatatcaccatcaccacattgctgaactaaatatgcaataacagtaggtcttttctcattaggatgttccaacatataagtatctgcatattttttatgttcattccaaaaatttggatgattttttttgtaaatattataaattttagaccatttagatttgtcaaaattatttccaataccgcaaatacttttaatttcatcctcgtaattcttaacttgaagtgtatcaatattatcttttgatttagaaaattgttctaactttcttgtatatttatttgcagactctcttaaatcattcaaatgctttttaaaatattcaattgcatctttatcaaaagtaataacacgacctttaacatgcatatactgactaatatctgtactaatatctttataattagaaacagccttatatgtattaagacgtttattgatacttaatgttaataatcctaattcataaagataatattttaaacttgttggattaagatattttacatctgtaagctggtcgcaaatgtcagcgcatgtcatcatatctgttgtgtcttttatttctatttcttttttagcatcttctttaagattcattatcacaattcttaaatcattatattcttttaggagattatgatgttcttctaataaagactttacaatattattcatctctaatttatatttgccaaattcattcccaatagaaataatgtctgatttattattatcagtgtcggttcttaatccagttgttttctgatttaattccataatttcagtgtcataatttcttccaaatttcatatttagttttcctccatttcaatatcaataatattttcatcgtttgtttcttctcctaaataggagagcatggtttcataccaatcgttcaacatatgcaaagttgaaattaaatttgttctcagtatcttattctcttttattgcataaatgtattgttggtatttaagtggtgcgagttgattttgaagtaaatccataagagagctatttagctcagtgatttttacagcagcattgaaagtattgtagtcaccattaggtttagtgcccatatgtgcaagcttttcttttactttcatatactcttcagattgagatttatattcagcagctaaatcgtcagatattttcttttgagattccaatatcttattctctttttcaagttgttctttttcaatttttaaagtagagatggtgagtgaatcaggtgaagtatctttcaactctttattctctgcctttaactcttttattgtctttatatattcttttgcttctttttttgttattttcttggttatatccaaagaagatatgagatcacgctgttcatcggatgataaattacgaataattgcaagagctgtatcctttgtgacaattcctgtatcaaccaaatcctctaattctggtatcatacttgccatacgcatgtaattgttcatggtttgttttgtgattccatatgactcagcaagttctgtttgatttgatggaatatctgagttagcaaaagtaaaaagtttttccttttgctcatgttgatttgaaccatttccttgatgaaatccataatattcatttaaaaatgaaaaacaccttcctaatttaacaggattcgtatttccaagaactctctgacgtagattggactcaataagatccttaatttcttgattttcattttcatattcaatcatcttatatgaaacttcttcgattcctaataccttacaagctcgtattcgctgatgacctgatatgattactttattttgagttatggtaattgcattggttacattagatgtacttattgattgcagtaatgagtcccatgcatcaccttccatatcatcaaagtaaaaattattttgaggatgtggttttaattcagatattttaatttttccttctgataacatttctttcctttcttctaaaaccaaatttacagttacaatttgtgagatgagagtgtgataagtggttcaattagttattctctatctgattttgtatttccataaaatttttcatcatacatagaatcaacatcaatcattatctcatctaagtcttttgtttcattcttatcaatagagagtagaagagtaagtatatctttattctctttatgtattgcttctagcatacgttttaaatctttcatatgattcctcctattgtcaaaaaaatcatttgggtacatacagcatgtacccaaaagtgaaaatttacttcatttgggtacatcccagctatcaattttgtgcagtctatatctatatagactcatattatcaagagaagaatattccgtttgtatttcgctaacgctacatacaaactccataaatttttggttggttgttattgattgatttaggtacatggtgttttggattggtactttcatttgggtacatatatgatgtacctatattatttctgatgctgaaacatattatttatttcctttaagtgaaatagcatataacatatttctaatattgaaaacatatatccaaaatattcaagattttctcttatatagggatttgataattttcttataacagattttcttgttcttttaaataaaattgacttcttcataatatcattctccttctgaattattttccgtattattctctctttccaaatcaacatacttctctttataaatatcctctacaaagaatactggcaatttatcatggtacttttcatataattcctcgtcaggaatatgagagtaacatttacctattggagtatctactgttctgatataatcttttacaatagatttattttccttgaatcgctcatttatttttccacaaatagtacagtaggtgtataaacctgtattaagataggtttttcttataaatgcgaatctatattggattaaacattctttataatgatgtttgtgttttgatttgcgattactctttgagatattgctttctgttgacttgagatattttggtatttcgttttcttgtatcatgtaattcctcccataataatctttgtttttctcttgttaactcgctttttctcacattttcatttcttcatagagatattttctaagtctatgtcattccccttggccatgaatcatggatattcggatgtttagggtgcacaaaataagacgtcgtcttattctgctatgatcggcctttctttccccaactccttacggcagcctaacctcccatgtcatacaggatctcctttacttctgggtccttaattccttcgttctgcttatccataaaggggcgtcatgatgctccttcgctgagtctctgctctgatggaaataaatctgacttggctctctatgtttatgaaattcttctgttcctttcagcgccttacggcggacgtctcctgaatctcacagttggtcttcttacgctacctgcggctgcctgtgaatgtcagaaatcaacttctgtgcatcataggtcactccttttgccaggatggcataaaagacccgtatcagcttacagctgatggcaatcacggattgtttcttcttgagtggattgttcgctcttgtcgtgtaatactcatgcaatgacttaaactctgggttcttcgctatcagcggaattgctgcattgaacagtactgcccgcagcttactccgacctcttttgcttatggtcgtctgtcctttgtgctttcctgagctgttctcccgtaatgagagtcctgccagcttttgtatctgtctgggtgattcgaaacgcctcacatcacccacttctgccagaaatccggctaccgtgattactcctatacctttgatggcaagcatctgctcgctttcgggtatcttcctgcacagcttttctatttcctccataacggcatccagctgtgcctttttgtattcgtaatcctcgagcaacagtttcatttcatactgggcagccgaagagcctttctttaagccgatgctgcgttttgctgtctcacacagggtcgttgcccttttcattcccacagccctaagctttgcatcacgccagatttgattgattttctcggctcccagttccacgattgcttccggagtacaaactttctttagaagcagcatactgctctgtgcttcatagtccccaaacacatctgtgtactcggggaaatatatggcgaaccatctggcaaatctgtttttgatctgggtcatctccctgatgagtctcttacgattggccaccataattcttaaatcagcatacacaccatccggtgtatacggtgcagaataccggccctcggtaaccagctttgcgatcaccttcggatccttcctgtcattcttgctttggctgttgtcatccagttccttggtctgctttaccgcataagggttaaccataaccaggaggatgccctcatcctcaagataagcgccaaggtcaaaccagtaatgacctgtcggctcgatacctacgattgcatccagcttcttatacttgtcctgtaaatgctgcatccatgctttgaaagattcaaatccttctctgctgttgctgaacggaaagactttcccaagctcaatgcctctccagtcaaatgccctggcgtactgtgtcgtgcttccgatatcgattccaactaccaaagttgattcttttacttgattgattttttcattctgcttataattcatttgtgggtgtctcctttgaacaatgattcttattaaccgccaagttaacaatcattattctatgggtggcactcattttttgcaaaccggttatttgttacttaacaggaatgctcctttaatatattattctctcttttgatattggcttgttatcagttgtctaccctaaagatattcttttcttgctaacgctgcgaaaagaccgtccctattaagggactatatcttgtgcttacgcacatacgcatatacacacatatgacgtatattgttattttttcttattggaatagtagatttgaaaaatgtattgtttagtcaataaagtgtaagggtagtaggttagaattttctacatattgtcaggataatagattttcagcttgtagagggtattataagaatgaatgttatatattttgcataaaatacgttgcattattgacgaaacatttagttatattgtatagtttgagaattggagttaaaaaatatgaccttgtattttagcttttaaggtatgtaaaagaaagtgcgtggagagattgttgtctaaaaattagaacggcttatttgggctaatatgagcgttagagggtatagttgtatttttcgcgtaaaaataagacagtgtgattactgtcttggtaattttgtgtatagttttatggtagcccctatattatggttatatttgttctgagagataaataagagagttttatgtttaggaaagcattttatcattggaggtattttgaaatgaatttgggtcgatttcgtgagatttaagctagagattggggtatgagatagagttacatatattgttaatttaatgaacataaataagacatctgattttatcaaatgtcttatttgtattttttattttaataatttgttcataatatttacaaattcgcttatatctgcaaaatagttcggataagcttccctcaaatcattaaatgattgagcagacaccagtacaacatcaatatttttatcatgtttagcttcaatttcgttatatgctgtcgtagctaagtcaatttgttgagtagagaatcctcttacacgaagattcttttcttcataatttaaaattaaaacataatacccttttcctttcatgtttttagatgtattcgtatgatttattgcaacagacaatgcacttatccttgacactaaatgtaatttgttgttgatacttttaatttcatcggtaattatttttttgtcatttgttgtattagggcatatagacgttccctcttgctgagcaaaaagtgatgatactaaaacaaagaaccttaatatgtcttcgtttcccatactagattttaagttcgattttgtatatatccccatcatttccacagcagtagcccatatatgctgcaatttagtgcggaattgaatttctattaaaatattcttattataagtatcattatcatcactttgaaattgataaaccatatgataacttctataaccagattttttaggattctgaatataatcatcttcctttttaaatatatgcctcacttttgaatttttaaatttatttacacttttatatacatcatctatagattcaacaataactcgacaaccaccaaggtcttgcattctatatagactcatattggggaatcgttctattttacccataatagaatctaaacgttttaatctttgtacaactattgcgtttggattatttcttctaagattatttgtaattacttctaatggataagcatgagatgaacgccaattgtttagtatatcaattgcttgattaaaatttttaaaatcaactggatttttacttgattgtgtaagaaaatctgcaatgaatctaccggctttatcaatttgtttctttgaatatttaggcgtttcccatttaggattactaatcatattgtcaatcataatagaataccattccttcgttagagtttctattattatatcataaatatctttgcttttcattccatattctccttatattaatattttatgatatattattctctttttattattgttttacataacatttattagaaaaacaaaaatagatatcgaaaaaaatgcttatttataagatagaattttaaattagggtgtgatttttggaatatagaactttcaaaaatggaattcaaaatggctgaaaatattgattttactatgttttggcgataaggggtacgataacatatttatttgaataaaaatagaatttgcttgattttagtgggatttttaaagatatcgacaaggtaaaattttgaagaaggtctgtggatgaatcagctatatggtttattgaaaaaagcatatccaagtttagtttttgctacccccgaacacatgtttttctacggtttttctacatttttccgtggaattgataatagaacaaatgttcgataaaatcagatctggactattagagcagaatatattcgaacatatgtttgtattataattttatcgtattttttgaaaaatgatacttgacttcaagcaattcatatgataatatatagccaagtcaagagaataaacatttttaagaaattaaaaattgactcttgacaagtaacaaactatctgttatacttgtatcaagtcaagtgaataactaggaagtaataagactttaaacttctttgcaagcaatcctaaaataatacttgacaacagacaagcaacatgatatactttaaacaagtcaagcgattgacttaaatgttcaaacttatagcttatatatagggtagcaacctataaatagggtgcaaagtctagcacaccttacacccttacatagtggaacgcatgaaacgctacaccatagcaacatattctagcatatttcatgcaaaaattccacaaaaagtttgtacttctttaaaaaatacctttgtaaataggtagcaagtgttacggcacaaactacaccatgaaacaagttacggcttgcggataactatttgcattgaaaaacgggacaaaaatagattgagtcgagttcccaactctcgacactaaaacaagccttcaattaaccgttgggcggtctgatagggttctatctgaaaatggtagacgtgattcattcacaacggcgaaaagggtttactacataactttgtagtaattaaattgtcatattgaagtctgtatctatatccattcagagctagaggggcacatgcttaaaactaaggtgtcagtgcgtgaaaagattagcgcataatctgaaaaagattaatttgaatggggtgtacgaaagtacaacggtgtgaggcgcaccaggtaaggtgaggaggacgttataaagctaccaatctgcaaagattgacagttccaagtctgttaaaagctgaggataacaacgtacacaataaaaaatacatagcaccgattgcgtcaagtcggagaaagaggatattatgagtaaaacaacaaacaacgctaaagttgactttttccagtcagcacgcacattatcaacacggacttctgaatttttccgttgcattatcaaaaaagccgaactgaatacaatctatggctcaaaaattgatgctaataataacagtattgcagccattgacgatatgctcgaaaaaggtactaaccttgacgtaacagttgatgacctcaatcggatgcgtgctaattatgtaaccattaatgaaggcttaaaggttgagtgggataagttgctcaaagagcaggcttcttttgagtacaacgaacacgacaaaaaattccgcaaagctatgaaagatgctaagtgcttagaagatgtcaagacagcagtagaaaacttctataaagcttataaacttaatgcaacaaatacaacattcgagacagcagttcttgagtcaatcggtaagaagattgatacaaaaaccgttgtaaaatctaacggtacaaaagctcttaagtatgacgtaacaaatgcacttaaaaacctttatggtgtaggctttgagtggatggttgaagcaggaactatcaaacctgctgatattcctagtgtattgacggacaaatacacaaagaaatctaagaaaaacaacaaataatatgcaaccataaaatgtatagttagagagggcaaggtaaacactttgccctttttatagtgtacatttttaattaaggaggaaaacattatgcaaaaactcacattatttttaggaaatggaattataagggaagttatctgcccttattctgataaaaacgcaattaaagaatggttgcgtactttttatcctgtaagttgtagattctatagagaacaggaggtataaaatcatgggaaaagatagaagcatggcaataaaacatgcaaaagcgaaaaaagaagcaatgaaagaagtgttaaacgatcagaatgactttgcacaaacttcatggggacttactgacaatatgcgtaaatggttcaagacaaaaccatatgcattgacatatggaaaataaaaatgatagcacttgaaaaaagtcaaataatatgctatctttgaatatataaaaggaggcaaaaattatatgatagtatattataaacttgatacacttttaagcgaacgcaaaataacaaaaacacaactatgtaaagataccggaattagcactaatgttgtgtctaaaataagtaaaaatgaagtatttaaaacagatacattaaatcgtatctgcgaatatctccatgtccaaccaagcgaaatcatggaatggataccagatgcagaatataacaaggcaaatgctgaaaaacaagctatagaagctcaaatagctgaacttcaagcgaaactaaaaaccatgtgaggaggcaaccagctatgacaatagatgaaatacgtcaaagcatgacagaagcgggagtatattcaaaagcagacatagataaaatctgcgacttagaacagcagtatagagatgaatgcaaggagatagctgaacaatgtgaagctgaaggttatccatccaacggaagtaactatgaactccgttgttcagaagctcgtaaatactatgacgagcaaatagaaatcattgatgcaaattatgaaatgtaacaatgcgtcaaatacacccaacaccaaacaaagcacccaatttccgggtgctatttttatacccaaaaaacaaacaataaggaggaattattatgtatcagtacacaaacaaaaacggagaaacttttgggatcacacatacggagagtagcacaatggcttatatcaatggtttatatgtcgcacaggcagaaacagacagagaacttgaggaagttcttgaccatttctcacacacagatatcaagaaaacgcttgattatacaggaattacgagagaagaaaagactgccgattaagacagtctatcttccaaatactttctttaattcagaacgaaaagcagtattatcaaaaacatctacatcgttttcgataatgcctaattcttgtaatactttacaagtagtacgaatagaagcaaagcgatcaaagtcactgatagtacgcaaaagttttataacttctgcaactgtaattgtgtcgttcatatcttttttgattgcaccatgaaatgcaaactcaaaattaatatcttcacatttacaagcttcttcagaagctaaagctaattttgaaatcaattcgcttgttttaattttatccataataaaagcctcctttgtaaaataattatacaagggagcacgtaataaatcaaggaggaaatcgaaccatgaaaaacaaaattacatatcttatcatcacatcagcactcgtaatgagtgcttttttaataggcaaatccacagcaccaaagcagattataactaaaacagctatcaattctattcagttagaaaaggcaattccattgtcggatgtagcatgttggtatgtaaaagacggatatatcacggttgaattgaaagatgtaacacgtcaacttgacgacaaggcaaatgcaagttatacggatgttttgaaagatattccgaacgaaacaataacttacagaaataacatgattgatatatcaaaggtaactgattttacagcaacggaaagtaaattacagatataccttgaagatggatcaggatattactgggaaagataataaaagaagggagtgataaatatgtcagaaaaacagaaagcaacacacaatgcttattgcaattatgaagtcgcaaaggcaaaatcaccgtcacggatcatgtcggtacggacagaagtaacaagaaaaccaaagggaatcaaaacaacaggtgttagtcgtgctatgcttgcaagacagttggcttcactctattaatgtggtacaataaaaagaaaacaggagggaaaccatgaaaacagtgacttacacagaagctccaaatggagcacgttatttgtctaacgaaggcaaacagatggatatcattgaaccgatcagtaagaaagaatttgaagagaagtttcctgaattctctacatatggaatctcatggacagaaacatttcttgaaaatggcgtaattcttcttaactcagagtggaacggagaacattatttctctaatgataaagaatatgcacccgtttataatgaaatcgaagaggatgatacggaaatcatcgggtactatgaaatttaaaaggctgccatttctgacagccaccgcacttagaatcataccaagcgaaaactaggtgcaaatatataataacatattaaatcattaaagacaacttacaatttttgtaggctgtctttttttatgcacggaaaggagaatataaatgcaaaacttagaggatggaggtataagcaaatgattatagtggcatcaaacggttacgaagtaatcgacaacagaccagaagcagaaaacgcagattcacttgcaaaacattttgaaaatcggtatgcaagggaacagaaatgcaaacttgcaaagcggtttaaaaacaagcatcaattcgcacagaaattattatctgcttgcggattattatagaatggagaatataatcatgaatgaattatcacgaaatcagatgttaaagccaaattactacgcattgcttttagcagtagcgaaaaatgtatcagcaaaagatgcacttattgaaatgggaattagtccagataacgcaaacaaggaggttgttataaatgattaaagggaaaggatacgtagttccagatggatatatgggatatgcaaacggtagatatcagctttttgaaacagaaaaagcatactatgaatatcttcttgtagaggtggaattatgagtgaagaccagataagagaaattaagagaaatctttgtgcaaactgcggtgacagatgttgttgtcacggaatggaaatatgtgcagatgcgaacaaacatattgcgaagggaagtggcgaaaatgttagaatacagtgacttttacgacattgcaacatacggaaataatcattggagaggcaaatttaccccaaaagaagttgcctgttatgcttatgattattggtgcgaatttcagcattcaaaagcaaatggtgtaatgacaaatacaatattagttttaattgaaaatttaagagaagatgatacaaaagaagcaaatgaatggattgaaaaaataagaagggagattatctcatgaatgaaaaaataaaatacccatgcaggaattgtgcatattataatgcatgtggagattctgatatggcagaaccttgtaaaggtagagtagtaaaaactgaaactaagaaagataaagcgaccgcaaaataatgtggtcgctatttttatataaaaattagagtaaaaagaaaggttaaaaaggtaaaaaattatgtgttattcaagaaaagtagagccatcagtaattgaaagagaaatgcaggaatcacggaataaggaagagtttacaggtaaggttgaagcaatcacaatcaagcagattgttgaaaacgcaaaagtaaactcacgatttggcgacaagatacttgtcaatattaatcctttgcatgtacatattccatcatggcaaagaatgtgtgatgtagttgcagcaacggaaattggaataaaatacaacaagtataaatgggaagtaccgaaactgttatatcttaatggaaaactctggtgtgtagatggtatgcatcgtatttatggagctttcaaaggcaaaatcgaagcagttatttgtgagattattgaatgttcagagaaagatgcaattagtttgttcctttgtcagacagatgatagacgcaaaatgtcacaggttgattattacagagctgccgttgcaatcggagatacaaattatattaatttaaaagaaatctgtaatcgccataatgtagctgtaaagggagatccaattgaaaaccaggtaggtatttttacacctattaaagatggtattaagtcaattcgtaaaaacggaacggaattgcttaataaaattattactcttattactgatttacagtggaacggatatgcagatacatacaatgggaaagcatacactgcaaagtatattagagtgatgcattcactatatgcgtattatgaaggcagaacagaacaaatggagaatatcttaaaagagaaatgcattggcacagagttctttgttgaaaatattatgaacttggaacagtgtgcagtatttgattatttgtctgaaattattcgctatgaaatggagtcaccatttacggagaaaaagcgcaagtcaacaaagaaatctacaaaagcgaaagtgatgtagagaataaaaaagcaaaccaaatacatacaacatataaatacgaagctgggatagcggctatacggtcacattataataaggaaaggattggttgatatgggaaagagaagatggacaaatgatacacggattgtcaagcctattcttgaagcgaacggatattttgctttaaataatgggcataattgtaacggaagccatacgaaatttgtgaatgcaaacggagaagtaattagtgtgccgaaatcaattaacaggatgttgtggcaaagagaagtacggaaacacagtattgtcggtggtatgactgttataggcaaattaaaaagttaggagttgattagcatgaaatggaaagagattttacggaaagatggctatgcattactacaaagcgaaagtaatacacaatattgcgtagcaaatgattatgatccaacgcagtctgaagatcaacagtggaattatggaacatatttcacttattggaatgatacaaaacgaaaagccgattgtttacagaatgctctggattgttttagaagcaaaacagaaagcaattatgttacaaagggacagaagtatcttgaaatttacagagaagactatagcgaaggcacattcaatgaaattttacagtcacttgatttagataacgacatggttggagacgcttttggttgttattgtattgtggataaagagagtttaagaaagtgaggaataaatatggggcagttcagttggatatattcagatacaaataaacagcttgtagataataagaaggcagatacatatttgcttgtgccaaaaccatttcaagagaaatacggaaaggcaatttacgaaagttgttatgatggttacggaaatttcggaagatacgatgtatacgatttgattccagaatggaacaaagaaatgattcctgaaatcattcgtagaatcaagaatggaaattggcattgcagtacaagcgaaaacgatgttgcaaatttacaagcatattatgaagggaaagaaattgcttgtgaacttcgttggcttggaattataatggcttgttatgatgaagataatgaagcacttgaatattcaatcaagattaccacaagagaaatggaatatgaaaaagttgctccatcattgggcgatccgaatcaaggttgggaaacatctgatgatgacgaagaagaatggtggtaaaggcaagtaaatggatatttcataaggaggaatgataaaaatgacattgggtgaattgatgcctagttttggaaaattctattgcaaagagacttgcggaattgacggaagtgcattatacgcaaatagagtttatccgattgcagttgataaagagagaaacagaataagaattacagttgatgatgtcttcttattttcagattttaaagaacttgaaaaatatggaagaatagaagtgtagaaatgcgtgtttcattagaaaaaacggaggtaacggatatgagaaaaattacggtaacagaagacaattttgaaaaagtcttagaaaaattacggaaaatgtgcgataaatacaaaatgcttgaattctacagagctttatcggaagatcttacagaagtaaaatgtaagactaattcaatgggattacgaagtgagtttgataaagaatggagagacaagaatggagaatataagtacaaggtaaaaaagaaattctttatgtatagcaagtatgtctgtgttacaaaacatccttttagaagagattatgaaactgataaggaatcatataatgcaaaatatatgtatcctaaaatgaagagtttgattcaccttgatttatcagcttcgtgtgctttagtaattagtgaaggagataaggtgcagttttttccttttggtggtttcattatatggacagatgatgattatacgagatttgataatccacttacgatatataagcacatttatattccagattttataaaaggtaagattaaaaatcttgaacaggaaaaggaaacaagagaaaaggaatggaaatgggaagaagaagaagatgctgcatggtgggatgaacaatatgaaaaagatatggaacgtgaaatgaacgaatatatgtaagaatagaagtagtatttgaaattcgcatttcattacaaagaattaagtcgaaaccgccttattacaggcggtctatgcaagatagtaacttgcatactgatgatgacaaactaaatttgaatggaggatgatattatggcaaatattatggcacagttagaggcgttaagtaataaagattggcagaatttattttctgctatagaggaagattcacggagacgggttgcaagtctgaaagaagatttgcagtatagatacattggagagattgattgtccaacagaaatgtatcaagatttcgcaactgtaaaagatatagagggaaagggaaagataaattggtttgtttgctctgatggttcattttttacttgtgatgacgcaactgttgatgctctttatgatagtggcagagtggttgattatgaatttccatttgaaatagaaagaatggaaaagtatgaacagctttcaaaggatgaaagaatttcttttcgagtagccctacaaggaatttcagaagcagaagcaaaagaaattgtatgttgggaactaggtattcctgcctatgataatgtatatgtatttgaaatttcagaaacttatgttgatagctcaactaaggaagaagaaaataaaacatatacaaggaatatagaagctgacaatgaggcaaatgcaaaagagaaacttaattctgaattatttaaaattggatctgttgttagtagtggaaggaggtttacagcagaagacaacagaaaaatgcgtgaatctggtaaaatatttggatatagaggaggcataccatatacaattactttgaaaaacagagatgttgttcttaaagaaataaaaaagaatgatttattttaacaaagaaactaagatttctttggaaggagtgaagcgaaatgacaagtgttgaaaagtcaaaagaggacgcacggaacttaaatgaacttacggatcacttgattaaattacttgaatcagatgacaagcggttctcatttgaattttgtgcaagcggcacaatggagatttacgataaagaaaaggaaatcgggtatgcagttcatattgcaccgattgaatatgacgagaacggaaatgcaataaatttatagtaaacgcaaaggcagttaggagaataaatacctagctgcctattttattacaaggaggaaatgaattatgagaattgtaatcagaaacattacaaaagatacaatggttgattttaataatgaccatgtaattacattgccgatggatgaagaaaaattacggaatatgttaggcaatgacgaatggattattattgatacacctgtcggagatgaatttacaaacattgaaaagttaaatgctttattaagtgaaactgatgaagataatttgcagattttaacaaaggcatttttactcaatgagataatagaaagtggtgttgacaatttttcaatcgtagattttgatgcagaaacttcacaatataacgaaggcaatggagttatagccgatgaagaatggtatggaagagtactttatgatttaggatatatgaattttccattcacatatacagaagatatggaagattatgtaaagtgggaacagctttggtatacggcaaattctgaaggttggtgtgatgtgagatataacggaaatacatatcttgtgaaaaggtggtgttcataatgttaaatatcaaatgggataacggagttacaggatatttaagcgaaagcgaaaaagaactgtgtgaaaagattgatagagaaatcagtgcaatcaatgcaataagcaaaacggaaatatctgttgcaattagtattgaatgtggaaatcagtttcatataaagaaaaataatactggttctctacttggctatatgaatgcagatcaatgtttttgtgcattggaaggaatattggtcagtttattatatatggaaaaggttggtgattaatatgaaagagaaagctacacggaaatttttaaaagaaaattatcacattattaacattggtaatcagccaatgcaaacattatttacttttgaagatgcaagttattattgcacaagagtagaaggatgggcttgtgatggttatgtctttggtgattatgttattgtaactggatatgactgtccaggaaaattaattccatacgaaattactcagaaatatgaaaagaaagcaaaagagatttatgagaaatatagatatggaaattcaaaatactggacacaaaagagagttactaatacatataggaagatgattgaaaaatttattgaggaggtaacgctatgaatgaatgtaaattatatacagctcatttagctggtacttcatatgacggaaacaaaaaatatgaaatggtgattattacaaaatggaaagatacaacagaggattcaccagaagaaggacacaaggtatattatttcacacctgataacaagtatttaagcgaatgtattaaggatgaagattggtgtaaaaggatttatgaagcgtatccagaatataagaaatttaaaattgaaaggaaggttgagtgttatgttgaataaggaaacacctaaaaatacaatgattagagatgaaaacggaaacatccgtgaaggagttaaatggtatcttgagctaaatgatattcttgtacgattctttggtaacgaatgtgggtattcaagaggatttcaaagagttgtagttggggatagaggttatcttggtgatgtatttgaattagatatggataagcagccaacacaagaatttcttgactttatcaaaaattatcattcagataagataaagagaattgtatatagaaaagaggttgaaatgtacggaaaagtaatgtacagaaatgcagttattacactattgtaagggagtgatactatgacacaggaacagatatttaacgagaaaataaatcattttttaaaacatactaaattccagtggctaagagaatacgcagatgaagctttgaaatggaatactatgtgtgggttttatcaaattaaagcagaggatttcattgaaagaattgttgcagctccattggagtatatagaagattggttaaatggaaacaatcaattggaatggagtggaattaaaaagtgaagaaattgtaatttatttagaagaaaggatgaacaaaatgaaaaattttattgaaacattgttaaaagttttaccatttttcttaggattagcaattaatagaattgcaaataaaatgggagtagatttatttgattggaaagtgattgtagcaacaattattgtttttattgtttacataatgatatgtaaatggattgagggtaaataatacagagaataataaggcaagaggataaataaaatttgtctgctttttagtgtaactaacaaagaattttaagaaaggttaaggtaaatattatgagagtaaacgaagtgagaaaaacagaaacaattgagaagttggtaagaacagagtacatcgcagaggatggcacagtatttagaagcgaagaggaatgtaaaaagtatgaggaatcagcactgtttgcaatcagcaaagagttaaagagacttgataataaggaaaatggagcttctgaatatgatatttatgatgagtgttctgatgggtatcgagtagagattttcaatgctgaaacagaaagagatattgaaaacatcagaagatatgtatatcttaaagctctttcaaataactcatatgcgagaaaggaagatgttgatttacctaatatcacagcagggcatgaagtaattattcattggaactatgacgaggatagttgttggacaatcggaaatggaagtattgatgctttctgtggatatattagagagaatctcatgagtctaatcacaccaaaggaagagaaaacagaataatatagagaataataaggcagacgcaaacatatgtgtctgtcttatttattggaaggagaatgagaaatgaacggatatgaatatatttgcggaacagcagcacggtttagaaagaaatttccaaacttatatgaacggaaagaaaagaaacctgtgttcattgattcaagtttattagacaagattgaagatattccagacgagatcaaggcagaactgataggtaaatcaagaatatcacggatgaacagagaagactttgcaatcaatgcagaggatgaaaacggatataagtactaccttgatattgattgtagctgctatgacttctataaaaatgacaagctgatttattcagtattacatgtagacggtgaaaggtggaatatatataaggcaaatatctatggtgattatgaagatttacttgtaaagtcaggcagtttgaattggagcgaaaacttaaattttaagctaggtagaattgacattagtgcttatgaaagtgaggttgattgatatggaagttgttacaagagaatacaaagtatataacttttctgaattatcagaagatgcaaaagaaaaagcaaaacagtggtatttagatgacgattttagaccacaggaatttgaaaatatctatactgaagatttacattatttatttaataatagtgatttgaagatgcagttttcattatcttactgtcagggagatggattaaacatctacggaaaacttgatttaatggatgtgtttgcagctataagagatacggatcatagtggagagcagattaaacagtataaagatttattctcagaacacgagcagaaaactattgaagcatatatggaggcttgtggaagagaaattgagctgccatacaacagacattattgttattgcatagacgatagagttgattttgctgatgagtggattgaaatattagaatattgcagatataaaaatattcaaattgacactatcagaaaaatggaaaaattggttggaacgtaagtacgtaatcatccgtatctgtcagcaactatatttttctgatacactcttttcataacaaagaaaggaaactgtatcattatgaaaaaagatgaaaaaatcacactgtggtctgaaagaatccatgaatttcaattcagtgggcagacttgtaaaacatggtgtcaggaacatcacgttccagtctctacaatgaattactggatgcgcaagctgaaaaaattggacgaacaatcggatacagatatgatttttgcaaaaatgccaacggaaaaagaaatttcaaagaatgggactttgaacatcagcccgtctccagtccgcatttttatcacaaacgctattcggattgaagtgatgcctgaatgcccgccggaattttttcgtgttctgatccaggggctgaaagatcatgcttgatctggcaggtggcacaaccgtttaccttgcctgtggagctaccgatctgagaaaaagctatcacggactggctgcaattatcaagctaaaattcaaacttgatccctattcgcgctgcatgtttgcgttctgcaaccgcaggcggacttctattaagattctgcaatgggacggatccggtttctggattctgatgaagaggcttgacaaggattcctttcactggccggatactccggatgaattacagaaagtgaccctgaaagaaatgcattggctgtgtgatggtctttcacttactccaaagggagcctttgaagaaagacatccaaagattgttgtataaagaacggatttgtcaattcgcaaaaagcacgaaatccttgtggatatcggtatatattcctacacagtaaaacgttgatttttctcgaacagctggactttctatgctatactggaattatcatataagagtttggagattgccggatggatccgttttttacagaggaacagctgaataacatgagccgtgaaaacatgatggaagttatgagaatcatgcagaatcaggttcaaaaaaaagagaccgaggtacagcttctgaaagacaagcagaaagaactggaatttatgaatgcaatgctttcagaccgtcttgcgcttgcacaaagaagacgtttcggttcttccagtgaaaaatacgcagatggatatgaacagatggatctgtttaatgaggctgaagtcaatgcagatatggatactgctgagattgaagaggaaatcgtgattccatcgcacaaacggaaaaaacgcaccggcaaaaaagaagaagatctttctaatttcgaagtaacagaaacaatcgaatataaactgaccggcgaaaaccgctattgtccggactgtggaacaaagtataaagtcgtcacaaaagaagtcgtaaaacgactgaaattcatcccctccacctttgaagtggctgaagaagtaacctatgtatacagttgtccaaaatgtggtgctatgatccggccggaaaaagagtttccgctgatcaagggaagcattgctacaccttcgctggttgccggaatcatgaatgcaaagtatgtcaatggcatgccgctggcaagacaggaacgggaattcgcaaggtatgacttaaatctttcaacaaaaacaatggcaaactggatcatcagctgtgcagaccggtatctgggactgctttatgggcagatgaaggaagaattcctaaagagcagatacatccattgtgatgagaccaggattcaggtaattgatgaaccggatcagaaaggatcatctcaaaactggatgtgggtatatctgacagatcattacagtgaagccccacagatggttctctttgattatgagagaacgcgtgccggatatcacccggtaaacttccttggagatacatttcatggatatctgacgtgtgatggataccaggcgtatcatggactgaacgattccatcaccgtaaccggatgctttacccatgcgagacgccgttttgatgctgcactcacggcattaaaaaaggatttcacaaaggagcagctgaaagaaacagttgcatatcaggcaatgacgaggatcggaatcctgtataaagtagaggaactgatcaaagataagacaccggaagaacggtatcaggaacgccagaagcagtcgcgtccagtagtggaagccctgtttgaatggctgcattcgatggaagattctgtagacagatcttcccttattggtgatgccattttatatacgctgaatcaggaaaactatcttcgcaggtacttggatgatgggcatctgagcattgataataatagtgcggagcgtgcaatcaaaaattttgcagtaggccgccggaattggctgtttgccaagagtatccgtggtgcagatgccagtgctgttgtttatagtatcgcagaaacagccctgctgaatggtctgaagccgtatgtatatctttcctatgtattagacgaacttcgtaaaatgggaccttttccaaagccggatgatctaaatcggcttttgccatggtcaaatgaattaccggaaggatttcgaaccaaaaagaagaaataaaatgtgccgccctgatgggcggcatgtttaaaaaggcaaggtacagatgattacgtacttacgttggaacgatgtttgagaatttatctgctacatatgaaaaatatggatatgattatttttacaatgcagatgatgaagttgtaaatgagacgtgtgaagcaaatggatggagattcttagaagatggaacattctttgcggaataaaaccaaaggaaagaactgtttcttgaaaaggaagtgaggtaaataattatgctgagatatggacggaaatttaatattacacaggaacttatggacataattgcaacttatatgaatgatgacataagagaagatttacatttcagacttgcaccatgcgagcctgatttatttttaagagaatatgtaaagagagatcctgaatttgagaaacttttatatgatgaatttggaattgaaatggaggtgcaataattatgatgacagaagagagatttaaagagacaaattataaaatgagttacgaggaatataagaaatgttgttgtcacagatgcatgaaggaagattgcattcatagagatgcatatagaagattaccagaaattgatggtggtcttggtttgtgtcctaatttgaagggagagtgattgatatgtatcagcatatagaatttattgatggtagtaatccttatatcagcaaaacggaaaaggatttcaaatggatgtgtgaacattatgttctcattccgattgcagaaaatttctggaaagcaaccgatagaatttattataaagtagttggctttgcggataaaaataagatggctacttttaacagaaattacaaatcaaaagcaggtgcaatgagagtaatttggaaagcaattaaagagaataaatttgagtgtattgtacttagaaaagaggttgaagatttacggaatgatgaacactttgatatttcagtgagtacacctattaaaacatggaatttgggatagattggagtaatgaaaatgacaaaattagaaagtattaaatgtgaaaagttactgaatgaagctattgaatatgcgattgatgcaaaagacaaattggatgtagctgcaagacatcctaatgcaacggaaagatatgttctggaaaataccgcacataatcacagaggttatgcagaaggaattaatcagtcacttgcagttttaggatttaagcatgaacggatggtagagttagaaaaattgataggttaagaaatagcaatttcataaggagttgattcgatggaaattagagtaattgattgtgatgcaatcgtaggctttgttgattatggaactattgatagcgaaaagaatggtggttggtcaacgaagatgagatgtaaaaaatgcggcgcagcatggttagcagaaaattatataaatggaattgaaacatgtccaaagtgtaacgcaacgggtaaaaaatatgttattccagtaaattagaaaggacggttgatgattatgttaaaagcaataaatattaaatgggacacagatggaaacaaggatatattcaataaacttccaacggaaatgattattccaaatgaattggaagaactgtacaagaaagatagagaatacgcacttgaagagatctcagattggctatcagatgagacaggattttgtcatgacggattcaaagttgtaatggaaatcacaagacaatctgttgagaacgaattgtttgatttcttcaatgacaaaatgaaaactggcaatgcacctgaaattaaaagagttggtcgttatccggaagaatatatcacaatagatagcggaattgttattgattgtgtaggtggaaggcagattagattgattattcaggtagattaaggagtgatgatttatgaattatacttattttggaaacagaattgaaagaagcccattagggaatatggggttacagttattagaagctcaagagaaattagtttctcaggaatatgaagttgagaatcttagaattaaagcagctatgtataaagcatatttctttcgtaattccatattagcagaaaaattagaaaaacaaagtgaagaaaacagagatgcacttatcggagagtttgatggtttttcatatgcaagttggagagctaatgctgtatatagaacgcttgaagatatgtgcgatgaaggactattaactgaaaaagaatatagagaatgcaaagtatgaaacaagagtttctttagaaaataggaggtagaaataaatggaaaacaaaaagtataaagacatgacaaacacagaaataagacaaattgattttgataaatgcccatgtaaatgcacaacttgtttcgaagcttgtgaatgcgtcccagttggagcttgcagagactatttatcgaagaaatttgattaattttttagaagatgaaatgaggatttacttagaaaggaaattagaaattatgacaaattacgaatcaattaaaaatatgagtattgaagacatggcaaaaatgaatgtcaaagcatttatgtatatgaacggatatagaacaaatgtagaatatcatacaaccaatcagagcatttttgatacaagagaggaagcggaagaatatgaactgaaatggctacaatccaatgagggcagagaaacattagatacgattacttttaaaaacagaatgaaacgatgattttttgagttagaaagcgaggtaaaatatgattacaagagacatgataaaaaatggtttcgaaaatgggactatttcaattgaagaagagtgtttcggatgtttaggcatctgttgtaaaatcggagataatgctttttactttcttggttcacaagatgacaatatcacaaaagaagagtattggaaatcatacacattggatatgacaattgatatgatttttgacattcttaaagattctgaatcagcagaggaacatggactggatgatttggaaattggatattatgaatcagtattaaagtaaatgaaacggaaatttacttggtttagaaagtgaggttaattttatggattataaattgttagcaaaaaaatatattaaatatggaattaaatggcttgaaggtgaatttgatacatacaaaggtatgacaaccataatggaaacagaagaaaacctaaatggagaacaattaagaatgttgtgtgacgaaattaaaaaagacactagagttaaaatggcaatgattgaaagtgaacatgaatatactattacaattatgtttaaccgataaatcagaaacttcaaattattttaataggatacaagacatgatataatataaagaaaaacggaggtaattattatggcagagttgattgggtttgtattagcgatattgatttatttatggctttcaggtgtgtttagcggagaaaatcaaaacaatcagaaatttggtgatggaaaaaaccgttacgactttaaagattatgttgacaataaggcagataggtataataaataggaaggtggttgatgaatatgctagtagaaatgttagcattgttaggattaaaaggtgttgcaagcgtaggacgtgcagttgatgatgcaaaaacgaaaagaaatacgacagccttagattcaaatggaaatgtaacttgtataggtagaacaggtaagtattatgtcaatggagaagaaacatatagatggacacaagaagacaaatatggaaatcgacatgatcttacaataggtgtaaattccggcaaggtttaccgggataattttgacgatgaagtaaaacgaatgtcagctaatgatgaaaaaaataaacaatggagcttaagtcatggatatcttgcttataataagtatgatccacgatttcgaagaaatgtaacaacagaaattagcacaggaaaagtaatcgctacattatgtgagggatatgacaacaacagagcaaatgggcgttattataaattttattataaagagaaatcgccacactatagagatgattttaataaatctgctcctggtgattacggaattgaaatcagtgaggatgagtataataagttaaatatcccgacaaaaacatgtggcgaaataccagatgatccgaaagtattaaataaagtatggggtgttgattgtttttagattggagtagcaaaatgaataagaatagaagagaaaagataaatatgctcaaagcaaaacttcaaagtacacaatctgaactaaaacagatatcaagtgagttgtcttctatattaagcgaagaacaggatgcatttgacaatatgccagaaggattacaaagcagttatagaggaatgtattctgaagatgcaattgatagtatggaagaagcgagtgaaaaacttgatgaagcgattgagttgttaaatgatattgtgtagaatgtagaaaggagaatagtattatgaatgatacgccagtatatgaatgggaagatgcaataaattttattgcagaaagatgtaatattgacaaagatacaattgagacagtgcttacgttagaagaggactatatgaaaagtattggaattatcatggaagaacaatctaattttgagattgatggtcaacaaagagaacaaagtaaataatagattcattggaagattggagagagaatatatgaaaattgtgagtattgaatggctaacagacgaagtaacggaacaattaaataatgaagaaacctgttatttgtcaagtgataaagaatattggttatttacagatgataatgtgtttaataaaattggcaaagagttacattcgatttctgttgcagaatggttgtatggaaagtgtgaagacaatgatttatctacaacatttatgaatacacaatatgattggagtgattataatatggatgcagccgccgatgtagatgtgtctaaatgctgcaacaatcaatgggatcaggttatgataaactatgtgagaaatgtagttgaagaatccatttcgtataaattagaagaatcgttaagagaaatggtgaattacaaatttgaaatggattatataaaagatgctataaaaaatgttctggacttagaagacaaacaatagctaatgaaaccaagttttcttgtggaaggaaaggagtagttgatatggaacaaactttttatattggaatgaaaatttgtaattattatgcagttcatatcaatgatgatggatatgaacaaaaggaaatggttcaagaaaacgagattgatggatttatacattgtctaaaagttttaggatacaaggaaatctaagtttacttgtgaatggaaaggaatgataagaatggaatttgcaaaatattataatgtaagtaatctcgtagaagagatgaaaaaagcagaagaaattgacggttatccaacaggtgatgataaatttgaaggtgtatatgtttgtatggatacaaacgatttttggattagcagaattaacaagggatataatgaagaatatgaaagggaagatggaaaatatcttgtagaacgcaacaaaatcagtatctatgatgtaatggataaacttcatgaactatattctaagaaacttcctgactttaggaaaaatgatttgcaatttgaaatgaaaaataaatgtcatgattttttaaagagattcaaagcaaaagacatatgtaaagcagttatccttttagatgattatgatggattatcaaattgggattgttgcgaaacggattcgttagaagaagctattgaaattattgatggtggatatggaattttgccattagtagcataagaaatataggtttattatggaaggagaatggaatatatggcaaatgaatataaagtagaagaaacaaaatttggtactcgaacaagccatcctagttatggcactttgttatttaacagagcttatggtggaaagacaccattattcggaagcagcattgaacatagtaatgtaattacaatggaacttagacatgctgatatcacaagaggattaaatcgtgatgatatttttggcaataagcctattgtaaaagttgaaatgagttattcacaatttgctgaggcaattacatcttttggacaaggaacaggaattccagtaacaatttgctatactgaaaaagatggggaaatgcctccgtgtgattttgttagcaagagagaacaatttacaggagaatttaaagagcagactgataagacaatggaaaagtcaaaagaattaataaatgaagttgctgaattgttttcttcaaaaaagacacttacaaaggcagataaagaaaatattttaaaaaagctcaatatgttaacttacgatattggaagcaatattggatttattgcagatcagttcaatgaacagatggataaaactgttatggaagcaaagggagaaattgagtccttttgccagaacaaaatcaatgcaattgctaatgcatcattggtagaacatagagaagagtttctaaaattgggaaatccagttgatattgaatcagaataagccaagtaaatttaactttcctttggtatagaaatggagaatattatgtcaagaagaaatttatttataggcattccaaatgacaaattaaaagaatgctatgatagttatgttagagtgagttgtaaaagggaaaatgagcaagaattattttctgatttggtaacagaatataactcttttatagaaagtaatcatcctaaagcagcaaaagcaatttgtcaaagtgatatgttcaatgagattgcgaggagatattttaagatagctgatattattaaggataaagatttttgtgagatatttggaattgaggtgaagtaaatggaaataaaagactatttacctaaaagaattcgagatagagtcgtgagagtagatgttgatgccgattttgattatgagaaaaatcgaagcgttcaacattattttgtcacacttgataatggaatggaatttgacgctactacaataaaagagttgaaagaaattgcaaagaagattatataatgtaaatagttatggaaggagaatataaaaaatgaaatcagtagaaacatatttacatgatatacaagatgcattgtgcgataaaatcgtacatcattgggaagatgaccaacgttttgcaaatcaaagagaaatgcagcaatataattgtggagttgctgaagcaatggagattattaggaacgtattggatggacgtgaatttaagagtccattattacagtcaatgaaagaatgatttacttggaagattggaagaggtgatataaaatgactaatggcattaaagagaaagacattcgtgatatgcaaaaatgttttgacaaaattgaaacgattttaaaaagaattcaggtatataattctgaggcgaaaattatttgcattgaaagtgacacaatagccctagttaattttaatggcgagtctattgattcagctccacaaataaaagacgagcatattgttgcaagtgaatacatatcaacattggataattattgttaagaaatgacgatttcttatgaaaatttggaggtgtaattatggaatatagtgagttattaaaagcaaaaggatttagtttaaattcttatccagaaggaaaattttgggaaatgattgtaactgacaatgaagataagaagcaacatatttgtaatgtatttggagcggatatcgaactatttgattctaatataacggatattgatacacttattttacagtgcgcagaagattttacaaaatgtattttctattatgattgtaatccatttgatatggaatcaaatacattcatgaattgtgtaaaaaatatataacacaaagaaaaattgctttcaagtggaggtagatatgttatataatattggtgacaaattgaaatgtaagcaagaagttaactcacaatgtcttgagatgagtaaccccaaatttacaattaatattggagatatttatatagtaacagacaaagataattatcctgatgataatcattgtcattggtacgaattgacttttcaaaaagatacaagcgttattgtaaatgtttggaacgacgaaccagaccgtataatggtagacgataattttgaaaaaatcataaaataaaaaagatatattataaatattagaagcagaaaagtaactgcttcttttttattgcaggaatatgaggtgataaatatgtgtaaacgacatgacaatacaaacagatcaagtgaatttatctgtttaagatgtcttagtaaaaatcaagttggtgataaaatgcgtagaccgaatatgagagaaaaagaccatgtaaaaaatttgtgttgtctatgtacaaagttgcaaatgagaactaaaaatcttgaggttaggtggtgcgatgattttgacgagcgtatggaatatgcaaagaaaattaagtcaaaatattatgataaaaacaatgaactgttacctaaatggcaaacggagaatatgtatatagaaagagaggttggttaatatggcacagacaagagattatgcaacaaagaaaaagggaaaaacggaagtacagccattctggaatatgtctgatattaagaatgttgtggaatggtttgaaaagaataatgaatgggacggatatcttattacattattagaattgcttcttggtagacgaattggtgatacagttatgatgaaatggtcggatctgtattacgagaacggaaatcgtaagagtgaaattgataccatcgaggaacagaaaactggaaagatcactaatcttcctgtaagtaatatggtttgggaggcggttgacaattatttgtcacacgtaaaaattgacccaatggaacattataatgaatatatattcagttatatacctaaaacattatggctgttaagacatcctaatacacctttttatatgaatattgaaacatggtgtggttatttaaataaagatttttctgataagagaaagcagaaaattttggatgactttcataagcaaaaagaatacaagagtcttggagattatttatattatattatagaatacaatgatgttgtaaagtggcaaacagatgattatagaaagaaactaaaaaaagcggttgaggatgttggtattcgatatcctatatcaagtcacagccttcgtaaaagcttcgggtattggattcataagacacacccgtttgatcctgattgtcttttgtcattgcagaaattgttcaatcatactgatttacaaatgacaatgaattatattggattaacagaagagaaaaatagacagttgattaatgaccatggagaattcattcataacgtgcttgctggtaagggagatgagatagttaaaaatatgccagttgtctcattaaagtctgatgattttggaaagattataagaatgcttactgatgatgttgataaatatcaagctgcaattaatatggcaaatgaactgagaattttataaatatgtttgcgatatcctataaatatgtttgtgatattctattgacttttatgaatcttatgaatataataactattagttaatgacaataaacgacataagattggaggattaatatgaatcaaataggtagggctttcttaagtaaaacaaagttagacgtgaataacagtgacattgtggcaattgtggattttttatcctcggcagattccatcaataagatgatagtggtgtcggatttgggattacccgcgcttacgggagttgtgaaagatctcgaagagaaatttgcaaattgcaaaggttttcctttgaatcatgacgctcccgatcacaatgctccaaataggcggagtataggatggatgattaaattcatcatgaaacaagttgggtattcgccggtagatggtggattaagtgaaagagcaagattgcgagattttgcggggagcaaatatttttcaacgagtgcaatttatcaaaaaaattgtaccccaaagtttaaaatcaatgttgaactggcaaatgttagttaacaaaatgtaggattgccaatgtaataaaataaaaaaataggacatacttatgtgatttcgtccttatcaatgaaattaatatctaaatagatatttaatgcatcgcataattcgagtaaattattgattgaaatattttcttgcttaaatcgtgacgttaatgcagcctgtgagatatttaatttttcggcaagttcttttttctttatatctttttcaagcattatggtcttaagtttaagaagaatttgtttagtgttagctacttccatttttgtccctctatgtttcaaatgattaagatacatcttaattatataagatatatacaaaatatacaagatataagtaaaaagtttatacattattatatcttgaaaaattaagatatatattgactatttaagatatatggactataatgcaaagtatcaaaggtaatccaagtacataaataacaaagagaggaggacgtacatatggatttacagagatacgatgttataaaagcgaaaatcaaatatcaaggcgaaggatcagtccagactaaagaacgtccatatgttatcataagcaatccaataggaacaaaacatgcttctataattacagtgatgcctttgacaactaagctaaaaaaaataaacatgcctgttcatagttgcattaatgcagatgatgataatggtttaacagagtattctatggtgctcggagaacaaattataacaatatccaaggacgaagttattgaaagacttggaaatattactgatgcttatgaacgaaaacttatagataaagcttgtttcaacggcttgttttttggaactgaatatagattagaggaggcgagggcgtaatgtatgtaagtaaagaaaaggcaaaacagataattgatgaagctcctggtatgatatggattgattcttttaatggaatgacttttattcatacaagaccaagacaaattactattgatgaggggaaaagaataattaacaaggcgaatacagttgactatcagaataatgatttctttggattgctttcattagagggagtacaggaatttatggtacacaatattaaatttcccaagatagagtcctgattataggactcaaaatatgatataataaaaatatcgaacaaaaaccgaacatgatacaaacacctgttcgaaataatgattgacaagaacatttgtttggagtattataatttttgtaagcgacaaaaaagatagagccaagcgattcaaacgctgcgccaacagctttctacttgactctatcaaccaaatacatacaacagcattaagccattgcagaagcgaaatatcgcttgtacttattttacatatatttcgaaagaaagtcaagtttcaagcgttttctgcaattaaaattcctaatttgcacaattgaatatggagaataatattatagggcattcgccaagaggtaaggcacatgactttgactcatgtattcactggttcgaatccagtatgccctgttatggggattttctacccagtgagtcctcagaacgcagattaattatctgtaagtgcagtctataagctgcataagttcttatagagaataactcactaacgagttacataaccgacatatacttttgtttcgttatttgatatataccttccatatgtcggtctggatcattagttcagttggttagaacgctcggctcataaccgagaagtcgtctgttcaagtcagacatgatccattaaaaataaaagagaggagatgatatagttggattttgttataaagaataataaaaatgtatatatccgactaagtgaaaatggtaaagctgaaacatgcaaagaaaaaaatatggggaaatttacagaacagaaagcaaagaatattctaaagtcgcttccaaagactcttaagaatctgaattttcggatagagtgtattcctgatattaaaatggaaacacctgttcagaaaattgtaaaagaagagtcgaagaaaattatcgaaaacacagattatcaaccttctggcaatattacgcaatgggttgaaaaatttggtgcatgttcggatatttttaaagaagcaagagaaagatatgttgaattggaagatgagttacatacttctgatgcggctttgatggatgctttacatagtattgaacttgaaacaccgaaggatctttattctgcttggcttgtatataaaaagataagagagaatagaagaaatagaagacaacttaaagatgaaatgttaatcatacatagtattttagaagaaattgatgatacaaaaatcagcagagaacgtacacaaaaggctattgatggattatttgatcgtaaatatacatatcgagttgtggaggtggacgaaaatggtgatttgtaaaaggtgttacacatctatgattggtgtgatgtcattttctaaggacaagcatgaaaagttttgtagatgtccaaagtgttattcagagacaaaacataatcaaatcaaagatgatgaactggattttaaagagatattagagacaaaaatgattggagacatgcgaaagtgacagtaaaaaaaataaatttatcacccgatcagttggcaatagttgatagatattgccgtaatgatttacgagaattaaagaaaatttgtctgccgctaatatccatgaagggtgttgcagatatggaaattgatgatttgttaagtgatgcgatgaaggtattgcttgagacagttgaaaattatgattgctcaaggaatgataatttcggagcatatttgacaacaaatattaaacgttcgtatttagattggacaagagatagaatgcgagataaacgtgttaattatgcaagggatagaaatggagatattatttatgagtactacgaagagaatggagagaagaaaaaaagaaaagtaattcttaaaccattaacattagatgtaacgacagaggaaggaaaggaaattagagatacgatagcttcagattttcgtgtggagaatatttttataagagaaacaaaatctgaatggcatcaagaagttaatgattacttaaatagtttgtctcctttgcaatacaagataattatgatgcttgctgataaatatacaaaagaagagatttgtgaaattttacatattgaatcatttcattatgacaatcttttaaaaaagattacttctgatgaaaaaactaagcctttaaagagtttgatgggaggaaaaattctatgaaattaataagagataaggtaaaaaaagatacctgcatggcatctaaaatatgtggaatgattgaaagagaagatctgagaaatgatcatccacagcagagaaaatctggtcaatgggaagaagaggttagagataattttatagtaaccgttattcagaatgaagattttgatccaattaagatttgtgaacagcttacagataatggtgttatcttgtggctgattgatggattacagagatgtaccacaatagaaaattataaagcaggtaaatttgcacttggtaaaaaaataaatccatcagtgattgagtatcaagaagtaaaaaaagatgaaaatggaaaaattgttaaagatgaagatggtaatacagtatatgaaatcgtttcttttgacttaaaaggaaaaagttatgctcaattaccagaaagattaaaggaagattttaataattgtccagtagaggtagtaaaacatcttgattgtagtgatgaagaagtggggcgacatattgttagatataacagtggagcgaaaatgaacgttgcccaaaaaacaatcacctatatgtgcaatgttgcaaaagatgttaaagaattatctggacatgatttctttagcgattgtgcaaaattttccgatgttaaagatagaaatggaactattgataagattgtaaatgaaacaattatggggcttaacttttttgatcagtggaaaagaaatgcaatgcagcttggaaagtttttaaacgagaatgcaaccaaggagatgtttaataagttcaaggaatatcttgatagattgtacaatattgtaacaccgacaacagggaaattgtttagtgagaaaaatgcacttatatggtttatgctctttgacaagtttgaaaaaacaggatatcccgatgaaaaatttggagaattcttaaacgactttgagaagttaaagaacgtaaaagttgttgtagagcatactagaaaaccaaaaggaactgaagaaacaaacaatttatcatttgtggaaattgatacatgtaattctacaaaggataaaggaatgattacagacaaattacatattttagaaacacttttaaaagattttttagccaatgaaacaatgacgacaaaagaaacagagaatattaaagaagatgtcgaagaagaaactacactttcatttgttcagaaaaatgtaaattcaaatgtaattgaagaagacattgaatgttatgagggtatgattgactgttgcgtgagagtcgattcagaagtatacaagcagtgtaaaacggcattaattgcgattgtagcttatgcttgtaaaaatgaaaaagacatggattttgagcgatggattcaaaagtatcagaaaaatagttctggttttagcacagatcaaagaattaactatacatatatgaaaaatagctttgaaagctttttgaaacgtgggtaatttgtgaggtgagaaacagatgattttattattaggaaaaaataatttggttgaaaaatatgcaaaagagatactaaatgcaggcatagataatgatatggtttattatcccgacgaaaaaacgcattatagtgagttaccacagtgggtagaaattgcaagaaaagaacaaccttatattgtaacaacacaaaatattgagatgattgatattttcctttattcagatttagactttaaaattattacagtctataatgttgacggagaacttttatcaagaactcttacgaaagaaaaagctgtatgtttgaaagaaaagatgggattagaattgagatgaaaattctctttctttggaaaaataggaggtaaatatggaaacaaaaattaaagaagcaatagaatttttaagagacaacggatattatgtaacaaaaattcctgaaaaattatgtgaagttgcagaagaatgttctgaaactgggcatggtgtttgtatggagtgcagttgttttgtatgtttgataggaaacgattattaagaaagtcgatttcttcggattgtgaggcgagaagatgcaaataaatattagttatacattatatacagacggtgattacagtttaaggaatgccgaagattttggctgtactaatagagacgtagtagttgatgattttgaatattatgattatgttggttctatggaatttaaatatgaagaggagtggcgttgtaaaagcgaagcaaaagattttctttggagatttttatgtgatggaattcatatatcttatacacatccttggctacttaaagacttttatgacattatggaatctttagagaatgttattaatgaatatcaagagggaatatctgtagtccaaaggcatataacaggtaattatgaaggaacagaaataagaatagaaatattgaagtaaagttctttggattgtgaggtgaaaattatgaattgtgttatgcataaaaatatagtcaatattgaaattgggaaaccagttacttcgaataatagaggggaacagtttaatttaacagatggaaaacaatatttagttactggttttgatggagattgtataaaaatcaaaaatgatatagataaagaagagtggtattcactagaatatttctgcgaatttgaagaactgttttggtaagaaagttcgatttcatgtggaggtataaagtatgacgaatttaatagatatttataatgaaattgaaaacagtattaatagtttatacgattttgacttgagttcccaatataaaaaaatgatggatggtttgaactcagcaatagaagatttatataaatattacggtattagaagattaaaaatagatatagaacaatttcataagaatgagattgtaaaaattgagcaaggagaaggtggttgtttcttacttgggttagatgaaaatgattcaagaattgttgacttatacgaacatatggacttgtcgattgatgagctatttttctaatcacaaaacaaggagatcggtaaaaatggaaaatataagaagatggtttgagaatgacaaagtaaacaatggtcaggattacgagatttatgaatacgaaggtcatttagaagcaagaacagatacagttatttttatgatagtagagcctcatagcggaactagaaacagatggttacttagagttacaacagaaagtgcttttgacagatgggctaattcaactgctgttgaaaagtttttcaatacagatattgaactatgtaattatttacatgaacatcagttagatatttataaggatttagttggatatctttcaagagaatatgatgatatagcagaggaatattagtcagaatatataactttgaaaggagcatacaaatattatggaacagattcaggaaaatgaacagtggaaattgaatggcaactgtaaaaaatgtagaagaaataattattgttcaaaaccatgtactcgtcataatagacgaataagagcagaatttaaaggtcttgttgcagatacaatgaataaaatgacaggtggtgtaatgagagaagctattgataagacagtaaatggaatttggtaaattagaagaggtattatatgagtcaatgtattagaaataagtcatgtgagatttgcggaagaatagaagttgggttagtagaaatgagtgtaggaaaaactaaacattatctatgttattcatgtatggcaaatttcgcatcggacgttcttgattacgcaagaatgaatttgacagagaaagtcaatgaatatggaaatacatattttatagacaaagaacagaaaccacagtaaaacttcgtttcattggaaatttttaggaggtgatagaacagatgatggattatactgaagcaaaaaagatactcaaaagagatttaaatattatggttgaaaataattctcttccagatgggattgaagccatgaagactgctattattgtcttaggagcaatagaacaaattaagtgggaaagagatcttgcaatagagcaattacatgaattaggaggagagcttggagaaaagacagagctaattaaacatcatataatttgtaactgctgtaaatcggggcaggaaaatatagtaggtagaaggtgtcaaggatgcatagaacataatatgtttgaatgcatttcacagtaatcgcacatttcttgcggatttttggaggtgaaatcttttgaaagttgttggaaacaaagaagatgttaatcgaatagaattgtcacataaaggtttgaatgtcagttttaattgttctatgaagccattgccttatgattataatattgatatatctaaacctaaaacaattgagataatattcaaagattcttacgaaatagaagctttgatagatgtattagaaaaatttaaaaaagagtgttttgggcttattggagaatggagacaatattatgacgaataaagagcaaaataatttaagcaaatacatagcattaattcttagacatagacctgatgttgttggcatcacattagacgaacatggctgggctaatgtatcagatttattaaagggaatcaataaaactcagacaattacaatgaaaatgcttgaaaaaattgtagaagaagattctaaacagagatattcatttaatcgagagaagacgcttatcagagcaaatcaaggtcattctgtaaaagtcgatgtagaattgaaagagtgtatgccaccagatattttatatcatggaacaggtgttaaatattgctcttcaatcaataaacaagggttaatatccaagagtcgtttatatgtccatctatcaaaagatattgaaacagcaacaaatgttggcagtagacatggagaaccgtttatttataaggttagagcaaaagatatgtataatgacggatataaattctttttatctcaaaatgatgtatggcttacaaaagaagtaccaatctgttatttagaaggagaataatacaatgtcaaatttatatgtatatttaattcgttctcgtaacaaggataataaggatattccaaattttaagcaacgagataagacaattcttgaatataaagagaatgaagacgaaataattgaagaatttaaaagttttgcaactaaaggagttcctggtgaacagacaagattatatagatcagttaattctaggaacgaagagaaaatcagggaagaatttattattcgtctgctgagagacaagccaagtatgacacagcttaatcgtacattagcttcagttgcacagcaagtacaaaatcgtgacgagagtaaatggttgtttgactttgatgtggacaatgaagaaaaagtagaagattttattgacgatatttatttttattcagaattggataatcacgaattgcataagactccacatggctatgcaatcattgttccgcatagatttgatacaagagagttgatggaaaagtggaaagattatgatatcacattgaagaaagatgagttgttgtttttggatatgataacgaataagtgatattttattgatataccaaaaattgaggtgaatttggatgaaaagattgaaaattgaaattccatctggtgcaaatgaaattatccatagtctacaaaacaatgaatatgaagctttcttagttggagggtgcgtaagagatagtattcttggcagaataattcacgattatgacattacaacttctgccacaccagatgaaatgatggaagtatttaaggataaaagaattattgaaactggattacaacatggaactattaccattataattgacggtgaaggatatgaatgtaccacttacagaattgacggtaattactcagatagtcgtagacctgatagcataacatttacacgaaatcttaaagaagatttaaagcgtagagattttacaatcaatgcgatggcatacaatgatgaagttggacttgtagatccgtttaatggcatggaagatattgagcattataaaatcagatgtgttggtagagcagaggatagattttcagaagatgctttaaggattttacgtgctattcggtttgcttcacaactgggatttgtccttgaacctgatacagattggaatatctctaaaatgtataagaatttggagaatatatctattgaaaggatcaatagtgagttctgtaaaattgctgcatcgagtgatttctgtgtacaaatggtcttatatcacgaagtattctcattgttcattcctgaaattaaagatatgtttggctttcaacagaataatccatatcacatgtatgatgtatggaatcataccgtacatgcagtacaagcatattcttgtgattgtgaagaagacttaaatccaatagatttaattacgtcattagcggtgttctttcatgacataggaaagccacactgttatcaagacggtgaggatggcattagacattttaaagggcatggaaaagtcagtgctgatatgactgatacaattatgaaaagacttcgttttgataatgatacaagagaaaaagtagtgcagcttgtttattatcatgatgcaacttttgaagtgggtgaaaagtatatcaagagatggctcaataagattggagaagaacaatttagaagattactgaatgttcgtagagctgatattaaagcgcaggcttatacagagcaagagagtaggcttcagaaaattgacaatatcgaatatatcttagaggaagttttacagaaagacgaatgtttctcactgaaagatttggctgttaatggcaatgatttgattgagattggatataagccaggaaaagaaatagggaatacactgaattgtcttttacagttagtaattgaaggtgtatatctaaacgagaaaagtgagttacttaaatatgttgagacaacaaaagaatggatgaagttaggagagaattataatggtaagattatttagccacagtgatttagacggaatcggttgtgcagttttggcaaaacttgcatttggtaaagatgtagatatttcatactgtgattacgacaatattgattcaactgtaaaggaatatttggaaacagaacaggacgacacaatcccaatttatattaccgatattcgtgtcaatgaagaaactgctgagttgctaaataaaagaggcaatgttcagttattagatcatcatccaacagctcttggattaaataagtatgattggtgtgatgtagttatcgaagattccaaaggaattaaaacatcgggaactatgttgttttatcattggttaggtatgaatggtagcctgagtgaagagttagagaataataatgcgttagagagatttgctgaattagtgagagattatgacacttggagatggtcagaacttggtgaagatggagttatttgtaagcaggtgaacgatttactttatctgtatggtcgagatgattttattcattggtgtatttcggagatacgtggtgaaatattcccattgttatctgctaaagatgaggttgttctgaagattaagcaggatgaaattgatagatatatcaaggagaagaatgaaaccatgtttaccagtcctatgtgtggtaaggtttgtggttttgtatttgcagataggtttgttagtgaattaggtaatagactttgtaaaatgcatcctgaaattgattttgtggcaatgattgatattgatggttgtacggtatcttatagaaccgttaaagaagatattgatcttggtaaagatgtagcaagtttatttggtggcggtggtcatccaaaagctgctggttcagaatttggtcagagtattaagttgaaaattattggggaaatctttggacagtgaggtgagagaataattggaatggattaaatgtgtcgaaggacaaatgcccgaagatgataaaagatacgaaggtaagaaagtaattaatgtacttgttactacgaatagaggcatggtaacaaaagtacaaagacaacgctatgatgggacatggttttggggaagaattaatggtggcatgaaagcttggatgccgttgcctgaaccatacagagaataagcgaggtaaaatatgagaaaaagtaaatttacatatccaaaatgtccatattgcaagaaagaatatcaagatggatttatggaatatggtttgatgaatttggtaacacaaggttggtgtgaagaagtaaaagtaaaatgtcataattgtggtgagtatttcaaagtgaaggtacacatcacatattatggttcaaagttggcgaggtgagagagtgaaaataacaattgatattccgagagaatatgaacgagattttagcgctggcaagttcaaggatttcttttcaagagtaattgcagatattgatttcaaaggtatatgtggtaattatgaaaaggaaattgcagaaatgtttttagaagcgtttgacaaagctattattggtgatgttaatctaaatgcaaaagttattccagttgcaaatatatcttttgacaaagaagatatgcagaagatgattcaagatgaattaaaaaagtttcaaatagagaataatctaatatagaagtaattctattcacggctgatcagccaaattaagcgaggtgataaagtgaagaaatattgggaaacaggtgaaaagaatgactttggtaaggaatgttacaggttacattttagtcaattttatgaagaagatgatgaaaatgtagtagctggttttgtacaagatgagacagacgaaaacatatttatatatgtatcaaaagaactaaatgttgaatatgatacgttgtttgcagacagtatagaagatgcaaagcatcaaatcgaagacatgctaatagaccattggaatgatgagattgattatttagaaaatcgaattaaatcatttcaagacgaagaataatcatacatagaaatttctatcttggcgactcagccaaatttcccaaaagtaaaagtaacaagaaatatttttttcttatggtttttgcagacgtgcaaattccataggattttacaacaaaataattaagaagaaaggaattaagcagtaactcctaggtaattatggttacgtaacctctgtaaaatagtgtattttgacagagaataataaaaaaaataattctcaagggctacgagtattaagtttatgtggtggcgttgaaacaggattgtatgcgttacagcagctcggaatatttataagagaatatcatacatatgaaattttgccagaagccatagcagtttctcagtaccattttccgtttgtggtacatcatggcgatttatatgaagcggattttgaacagttcaaaggatttgatttactgttggcaggaacttgttgccagtcactttcaagagtgcgaattgaaagcaaagaggttaataatgggcttgatggtaagtcaggaattttctttaaagcagttgagtgtctcagggcaattcagcccaaatatttcatgtttgaaaatgtaataccaagtagtgatgaagacctgaagacaatgacagaatgcattggtgtagaacctattttgattgattcaggaagattttcgtctcaaaatcgtgaaagatattattggacaaacataccattaggtaaattacccgatgaatctccattagttttgaaggatattatggagaatggtgtagatgagaaatatttttataagaaagattttgaaatcttggatatgagtaaacgtgtatgtgcagagttgaaagttaatacaactgagatgtgcaaacgtatttttaatcccgatttcaaaatgtctacattaacttgcgtgtcaggtggatatcaggaaaagaaggtattagataggggtagaccacgaaaacttacagaagttgaatatgaaagattacagggattgcctgataattttacaaaaattcagcttaacaatcgttggttatcatactcaaaaagatgtagtttgatgggcaatggatggaatgaacctactgttgaatggattttgagtgggttaaaagaataacataatatgaagttcgcaggaatgcggaatttcttctgagttttcagagaataaatacatataaaaacaaagaaaagaggattaaatgtatgagtaaagctattttagtgttagatatgcctggaacttgttgtgattgtaatttttgtagagaaatacaagaaggtattgaagcatgttgtgaattaatggatgagccaaatgataatactctttgtagaatagttgatagtgaaaatggatattgtcaagaaaaaccaaattggtgtccattaaaagaattgccagatgagacacacaatgatgtatatatggatgaatattgcgatggttatgatgatggttggaactcattaagaaaggaaattttaggcgaagatgaggagaataaatagatgacagttggtgtaaaaatatgtgaagcaaaagatacaattaagaaatacgaaaaccttgggtatagatttgttagtgaagaaaatgtgggtgaaggatatttaaaacttaacttcagagatccaattgttccagaagagaataatacaacagatattcaatttcatgaaggtgattatgtagaaaatagtgatggcaaagttggatatatttcatccatttgtcattgtgatgagtgcaagaggcgtggattctttgaaccaactattaaatattccgatggaacaacagattacattagcaattattctgttaaaactgtttcgtctgattataagcagattggaactcagaagttttcaacagaagatatattgaaaaataaaatagctgcacttgaaaaagagaataaagaattaactgaaaaggtaaattatttgactgatagaaatcatgaattgctcagtctatgctgcttttatgatatggaaaggaacggatgagacaatggtagatattcaatgtaaagacggaaaatatattattgacgcaagaattcatagtgaagttgatacaaatgatattgcaaaagtgcaggaaagatttacttctgattgtgcttatgagtttgcagaagctatgagagaagcagtaaacgttagccatttggtaatgaaagaacaaagaaaagaggtaacaaaatgagagaaacattaattgttgtagatatgcagaatgattttattgatggaacacttggtacaaaggaagcacaggcgattgtatcaaatgtagcaaagaaaattaaggagtacaaggatgctggtaaacaggtaatctttacaagagacacacatcccgagaattatttagagacatatgaaggtatacatcttcctgttactcactgtgtaaagaatactgctggttggcagatttcagataagttagattttgatattgataatgacattctgattgacaaaattacttttggatggactcattgggatgattttagatttgaaagcgttgagatttgcggattatgcaccgatatctgcgtgatttcaaatgcacttattattagagcaaactatcctgagattgatattacagtagatgcaagctgttgtgcaggtgtcacacctgatactcacaaggctgcattagcaactatgaagatgtgtcagattgaagctattgaagaactaaaatatgattataatgaacttggcaaagcaattccatgtgatacttcatggggatgttcttttgaaaatgcttatggaatggcaatacaagcgcttgaaaaacagataccaaagaaagtaaaaaatagcggagagagagttccgtttgaatggtattgccctacttgcggagaattattgtgtgacgatggctacaaagataccgacattaaatattgtgatcaatgcggtcaggcattagattgggagaatacataaatgagtaactgtggcaataatgactgtcaatggcacaaatattgtgaaagcggtttgatgtggcatgacgaagatattacagaatgtcgtcattggattaagccaaaaccaactaagatgaaaaatatcaaggtagctgaagctgattatgataaggcggttaaggtattaaaaagaaacaagatagagtttaaataaataatgaaaggagacgaggttcgtgtacacaagaaggaattccttactccaagtaatttatgaaatatatgggttcaaagtctcgaatagttgataacattttaccgattattcaagaaagattgcgagattataatatcaaaacatacatagagccattttgcggtggttgtaatgtaatcgacaaagttcagtgtgatacaaaaatcgcatcagataatcaaaaatatttgattgcattgctgaagaatgtacaagaaattactgaatttccagatgaattaacaagggaacattattcagaagtaagggaatgttttaataaaggattaaatacatatcctgattggtatatcggtgctatcggctttcttggaagttataatggcagattttatgatggtggatttgcaaaaacaaattattcaaagagtaaaacaacagaccatatcataataagaaattattataaagaggcaaaagaaaatttaattgaacaaattccaaggttagaagatattcaattccaatgtggagattatgaagagttatattctgataaagttgactgcttattttattgcgatattccatataagggtacgaaacaatatggatcaagtaagaactttgattatgacagattttggaattgggctgagaagatgagtgagaggaatattgtcttagtcagtgagcatgaagctccttcagaatgggaatgtatttggcaacaggaagtcaaaagaacgattgacaatacaaagcgagttaaagcagtagaaaagttatttgaaataagagaataaatatctgggaggtgataatttgatagaaccaaagtcttgtgtacaagaattaatatctatggaatgtatagacagaagtgttttaatcctatatccatatggacttagcaatgaaccaatattaaaagacaatattcccaaaatgacaaaagtgataagagaatatataaaagagtctgagatgtatagaaagtgtgtagatacaattccaaatcttatatgggattctcaaaaaatatctatgcaaaatgaagctgatgaacatcaaagaaaagctgatgaacttgcagagaaaatgaatgaaggtatcagtccttatgcgtggtatgtcaaaggtaggtttaatggagagataggtgggtttcactataatgtagataatatagtttatttggacaaaaaataacaagaatttttggtttcctatggaggtaaaaatatgttcaatagatggaaagcatatcctaaacatattcctaaaaagcgtggttggtatatatgctcaattagatatggcgaagaaccaggacaagcatatattatggatttattttgggacgaaaagacactaagatggaaagataatagacgattagatgtttacaatacatatgaagtatatggatataacgatgaaactcatttaaatgataaaaggatttataaggacaatgtttgcttcagagatgatgtagttgcctttaaaaaattaccaaagatttataagtaataagagaatataacaatgtaattacaaaacaaggaaaggaaaaacgttcacatgtgagtaaagctgcgcagctactaggtgaacaaatattggcattaaatattggatatttaacatcagataaggaagataatgagttatacacgccctattatgcaacagatcacattattaaatatcttccaaaggataaaattatatggtgtccatttgatgaaaactggtctgctttctacaacaggctaaaagaggaaggatacaatgtaatcagaagttcattagctgaaggtcaagatttctttaattacgaacctgaaaaatgggatatcatagttagcaatccacccttctcaatcaaagataaagtcttagaaagactttattcattcaacaaaccgtttgcggttcttctaccgcttaattccctgcaaggtaaaacaagatataaatatttcaaagatggtattcagattcttagttttgatgcaagaatttgttatcacaataaagaacatatggattctgtagtaaaaggtagtccatttgcaacggcatatttctgtaaagatttattaccaaaggatttgattgttgaaaaattggttacatatgaaagaccattaggagaataaaccaataggaaaaccacgtttcttttagtcgtgaaagtaggtgagtgaaataacagaattagagaagaaatactataagcttctgataggcgaaacattccattgttatgatattacattaaatgaattgcttattattatgaatgcagaacttaatataaacacattatctttacagaaatcaggaaggcataatttttattgtagagtcgatgataaaaccaaacagtattatctacgaaaatttggattattggatgaagatcaaatagaaataggagaataataatttgaaggatacattattggatgtagctcagaactttgacaaaatgagtgattcagaaaaagtagaagtaaataataaaattcgggaaaatgtcaaagaaatcatgaagcctcgtccaaaaactgaacgagaaaaagaacttgacagattggcaaaggaagaaaaagaagagtatgaaagaaacaaaaatgctttctatgctgatcctattcattggaacaacaataagcgtagaagacatgggttatctgtattaagaggcgatgtaaataaataccgttcaaaaacatatccagtgttttatcctactgtaaaattctttggtttgttggaagatattattaccgaaatattagaagataattttaaaaataatgagtattttaattcttttgtagaagtaaaagatttggcagttggtgatgaatttgcaactaaagaaaagccttggatgcagagcagatttacagctatgttgccaattaagtttgatgtagtgaaggatggagaataacagtatggagtcatcacaagatgaaagacaaaaatttttagaattaatagataaagtaagtccatgtgctgcaatttctggaaaggaaaatcttgaaaagtttaaagagtggctggatagtgataggtcaaaaagagttacttttgttgaagctcccaaaacatttaaagatcaagttggaaacgacaaagtgcttcttataccaacaaatgacgaaactataaagccaataagagtagtattcgaaggagaataacaatatgaacaaaagacagaaaaagaaactatttaaacagacgcttattaaggttaggaagctacatccacagaagggtgatgtgatttgctttcagccagatttagattggattgatgctgaaaccatgtgtgagttcatgaaagtttactcaaataatgacgtttttggtgaagcagggttggcttttgtacctgctaatattaaacagttatcacataaaaaatatgcacagatgtatattgacaagttgcagagtattgtagatcagatgggagaataaatgattagtcgagttgatttagaaagtacagatgttggtgaaaagaaatattatcttgtaactcctgaaggtctaatatttcatgaaattccatttgaagaaacacacaacctaacaagagaagtatgggtatcaagatgtccttgttgtggtagaattcaaggatattattattcaaaagatgaagccaaacaaaatagcaaattttgtggtcaatgcagttgtattcttttggttttagcaaagagatgcaaatggtattataaacagaatgtgaattttagacttttgacgcaaggttataaggaatatagaggaattaagtatccttatatggatattcatggttagcatgaaagaagcatttcctattgattttatctaagagcaattctgctcactatttccaaaataaaagagagaataactaaatataaggaggtatagaacttgcatataagaattgttggttttagcgacagatatgatgattataagcttcttggatatacagaagtagagaatgtatcagaagtttttaagacgctagactatatgagaaagaacgaaattcaattaataatcaatactaatgatgtcattgatacagacggagaagaatattacatagatagtattacaatggtattcccaaaagtgagtggcgagattgggagttgtattactgtttatgtggaagatgtttaggaggataaagatatgaaaatagagttaatcaaattaaaattcaatgatacttgtgcatataagcataagccattcacttattgctgtgatgaaattcaaaatgataaagctattgtatttacaggtgaagatttggtatgcaacgatacatttggattattagtaagagattcagatgacaatataattcctcaattttgtaattcatacacagaaacatttagctcttggggtgatgagtatgagcagacagataattatccaattcaattttgccctcactgcggagagaagattgagatttcagtcgtagatgagatagatgtatctgataagtataatgaattatctaagcagcgtgaggatttatggaagaagtgtcaaagaacagatagtaagaagaaagaagctgaactaatagaacaggttagaaagcttgataatcagattaatggtttctatttgttagatgagtggaaagaggatgtatatgtataaacaaattattattgctagaaaagatttaaacatgagtcatggcaagctcgcagctcaagtcagtcacggctctatggcatttctcagttggtttattagaaataatgccgatttagatggtcatgtcgatggctatattgacgaagatattcttcacaattggattgagggcgaatttacaaaatgtgttcttcaagccaagaataagaatcagttgctaaaagctaagactatggcagaagaattaggaatggttgaaggtaaagattttttggcgaatatacgataactgtcgcactgaattagaatccgaagaagatggtaggacacttactgtaattggttttagaccaatggacagtgaggttgttgatcagattggaagaaaatatcatttatatatgtagaaatggagaatattaaaatggcaaatagattattatttgagaaagacgtaataaaagcagttgataaacatacgaatgatgatagtcagttagatgatgatattagctgtattcttgaagaagtaaatcctgtcgtattagttggttcaaaagaagcaatagacagcttaaaggtagaaattaaaccagtacagaaacagaaacgagttgaactattcgagaatgaagatgtcgttttagagcagcgtggtaacagatattatttatccctctatgataaggaaggaaaatttcagagagaagtaactattgatgtgaaagacgattacaaagttggacttgggaattgtaagtaaattcatgtttcctttggtaacaaagagagaatattaaagcaaggaggtaagaaaaaatgtcgtattggacttatatcaacggtacaataacagttcgtcctatgggtagaacacagcctgagaagagatatattcttgaaacagtgttaaatcatctgccaagagtaacaggttctgaaggtgacatgaatacatatatcattcagaaaaatggttataacagttcgtgttcatgtgatgaatttggcgaagtgacaaataatttaactgattggtacggtaataaaagtcatactagaggagcattgagaacgcaagacgaatatatccttgttgtaaatgcagctttaagagacagagaatttgaacagacttacagagaatttatgaaatggtttgtgcgactttgtaaaagagtaggctgtgaagatgttcttgtagaaatcaaaggatatgataagtcaactgttatcaaagataggaatattcagagaaaaaagtattcatttaagagcgtttttgatgatttgtttgaagatccaagttggtgtaatgacaacaaagatggatataaagagccgaactggtgtgaatttatgatgtgggatagagcaaaagattctaattatcctatgactcttgcttacaaatatttcaacgataaagaaaatgatcaggaagttgagagaagaatgaattatagatgaacgatatagaaaggaataaaattatgaaaattattgaaacaggaactacatataaggtgtatggtgaagatttagtcgtattagacaatctgccagctcagacatataaagtcggatttggtcaattcacaggtttctttttagagaagcagcatgatttagagattaaagaggataaaatctacggagttcacgaagaaaaagcaaataaagtattgaacagatttgagaagtcacgcaaaaatttaggtgtaattctcagtggagataaagggattggaaagtcattgtttgcaagattattggcacagaaagcaattcagaatggtattcctgttatcttagtcgatgattttattcctggcattgatgatttcttaaatgatattaagaatgaagtgctcgtgttatttgatgaatttgataaaactttcgctagaagtaaagacaacgatccacagtcaaaaatgctttccttatttgatggtacaagttcaggtaagaagttatttgttgttacatgcaataattatagggatttgaacgagtatcttattaatagaccaggaagattccatttccatttcagatttgagtatccaacggcagatgaagtaaaggattatttgagagataagcttgatgagaaataccattctgaaatcaacaaagtagcttcattctcaagaaagattaagcttaattacgattgtttatcagctatcgcacttgaattaaatgatggtgaaacatttgaagatgctattaaggatttgaacattgttaatacatccgaaagacagaatacatacaaacttacattgttcacagaggaaggtgttgtattcagttcaaataatgtaaaaattgatttattcagtggagaaagcaataatatttggattgaggactcggcagacaatggtgtttatattaaattccgtggtaatagtgcagcatttaataataaatcaaattcttttgttttgccaaatgataaatttaaggtcgattatgatgaatattacattgatgaaaagttgagagatatgtacaaaaatcttcattatacttatgccgaaattactttagattatggtaatcgtattcactataagttactgtaacttcgcaagaaagcaacatttcacaactttagaaaggacaagcacaaatgaatttgaaaaagattagaagtgaagatttgatttttagcaatgaaattgaagatgatagaacaaatacatacctaacactgaatgattatgattggatgaattatataaggaatatcctaaatgtaaagctgctttgctgtggtggtgtaatttaaagaaatcgaatgcttttaatattgcgaataataaatggctgaaagagtttttgattgccaatccaccaacatttaaaatttcatcaaaatgttgtcagtatgcaaaaaaagacgtttctcataaattgataaaagaaaatacatatgaattaaatatagtcggtgtgcgaagagcagaaggtggtgtcagagccacatcatacaagtcttgttttagtgaaggtgatgatggatgcgataattatagacctttattttggtataaagattctgacaaaattgattatgaaaacgcttataacgttgagcattcagattgttatgttgtttatgccttgccaagaacaggttgtgcaggctgtccatttggaagagattttgagaatgaacttgaagtaattcaaaagtatgaaccgaaactttataaggctgttaataatatttttggagattcttatgaatatacaaggaagtatcgtgaatttgtaaagaaaatgaataaaaagtagagaataataaaataagaggttacgaaagtcttgaaaaataaggcttttagaatctcaaaatataaaaatattacatataaaggagattttaaatgaagaacacaaattggaaagtgtcagtaattattggagtaggagtattagcagttattttgatgattgtatttggtgtacagagttcgcagaataaagctattgcacttgaggagcaggtaaatacagcatcatcagatattaaggtacaggaaaagcgaagagttgaccttgtgtataaccttgctgattgtgtaaaacagtatgataaacatgaagctgatacattgacagcagttgcagatggtcgtggatcaacaggagatattgagaatgtaacaacagctattgcagcagttgcagaagcatatcctgagctgaagtccaatgagaactataagactcttatgaatgagttatctatgacagagaatatgattgcagaatatcgcagcaattacaataaacagattaaggaatacaaacgatatgtgagaaagttccctacaagacagtttcttggattgcttggatatgaagtacaggaatatgagtatttggattacaatgcaccagttgatgctccacaggatttgtttaaagaggattagtctatgagatatggtagaaaaggttttgattttggcaattttaaaataacaaaacgtgaaatcttggctagtatttctatcattgcatttatgattctgtttggtattctgatttcttccaagatttcagaacaccaaatggataaaaatgaaatttataacaaggctgttaagatagaaagtcaagaaatgttccaatacggaatggacacaaatgttggtaatgcgtttgtatatggtgatttaaaagcggtagatacggttacatatcctgaaattgctggagaatatatgtatgtagaaaaagtcaaagagagatatacgatgcatacaagaactgttacatatacaactggcagtggaaaaacaagacaaacgcatacaagaacagaaacatattggacttgggatagagttggaagtgaagatattaagtgtaaagaagtatcattttgtggagtaaatttcacaagtaataaaattgatttacctggtactgattatattgacacaattaaagagtcaagtcatgtgagatataagtattatggtgttgacactgaatataaaggaacaatttttacaaatttgagagataaaactatttctgataacacatcattttataataatttgactattgacgagacgatagaaaggctagaatctgatttcccaattattattttctggatcttttgggctattttaatcggtggaatagtatttggattctactatttggataataggtggttggattaggatttttctttcaagtgaggttagagaataaatggacaaagaaattaaaaataaattaattgaatgggtaaagaacaattatagtccaaaggcatgtggatatacagaaatgagatcttctggaaatgaatccgatgtattttgtgacggatatgattgtggcatatcaaacgctgcatatgaaattggttgtattcttggtatgaaattaaaagaacctgaagagcaggactatggcttctaaaatttaaatgaaatttttctttcattttggatagattggaggtgagcgacatctcagagctacatgataaattagaaaaaataagtgatgctacaaaagtcttaatagttggtaaaaagatagatacaataggaaaaataataaatgcaatgacagaaactcgaacacaaattgaacttgagcaagaatataaagacttacaagaagatcagattgcgaagcttcttgaaataattaatgaaatacgttttgatgataattttcctattgaatgttacgagtctccaaaacaagaaatatctactcttaaaaagagaataaaatattgtaagaatcctatggagaaaaagaaattagaacaagaattaaatgctttatataaagaatataaaagaaataggagaactactatatgaagggtaaatatagaggctgcgacatagaagtaggactagataactcaggtttcttaacctttgcagtattcgatgatggatatgaagttacaagtggattttctgaaagtagagactctgtaagagattatttcagctatatgaaaagtgtagtagatgactataaagaacatccagaagattacgaataggagaagtaaaatgagattaattaatgcagacaagtcgagttttcgttgcaactatgaaggtgattgttcaggagatatatcacactgccaagagtgtagcaattatgtgttagattatagagatataaaagaccaaccgacagcttatgatattgatagaattgtagggcagttgaaaatggactcttctgtaaaactgtatggaagtggcaacagcaataattatcttattcctcttgaaagtgcgattgagatagtaaaggcaggtggaacatgtcaataggcgatggaagaaaaacatattcagacagtacattgaagtctatgacaaaagatgagctgattgatattattcgctgcttagaaagtaatctcagaaatgctcatgatacaaatgatattcagtatgagaattgtaagaaattactgaatgaagagaagaataaaacacttgatgaagttctaaaaatttgtgacattgaatgtggtttttacagtggtgatgttaaaaatctcacaagacacgttttgatgagagtgctggatggattgagagaataagtaattgtgaggtgaacagatgagagcatataagtgtgatatttgtggcaagtattgtgaggattgtcataatgtatatggcaatattgcaatacaaacagaaaagaataatttcaaaaaaatgaaaaatgcaaaaatgaaaaatgtaaacgaattgtgtgatagctgctttgaggatttgcagagatatgtgcaagataagtattttgaatatatggataaaaactcgaagtaaagattcgtttctttagaaaatgtggaggtaaaaaatggagaaattttatattgtaacaaatgagaacttcctaaaagagattaatgattatagaaaacatggagaaaaaagaagaatagtagtaaataattttttcgaggataaaggcattgctggaaaagaatattatattagcggaagtggatctataaatcgcccatttgaagagtatgagaggcataatataagattatatattactgattgcaatgaaaataatcagaaatttggtaaagagttactgaagccaaataagctattctgcgattctgatacgttaatgagaaaatttagagctaacagtaagactttaaaagagtttcaagatttatgtattgaaaataatattgttattaacaatcatcccattcgagtaggagactatttcaaagaattacatttaggtgggtattcagtttcaaggtttgagtatgagaataagttatatttaaatatttctacaacaaaatatgaaactattacaccagatgacgatacaggctttacagaaattaaaggcagcgaattttataaagcacttgaagaatttgaatcgaagaataggtaaatatcgtttcctttagaaataattttgcacaaagaaagagagaataatagattgaacagtagtatttttattcctaaaacgataaatgttggatatcaaaatcgttcaggaacttacacaggaaaacttgcctatgtcatttactatgacgaaaaaggcaaactgcgaaaagaagcatcatggaatagttggcgtgacgataaaattccgaatgatgaatttgataatgtcccaacagaaggatttgtactaaataagaaagctggcgattactctacaggatgggatcacagacatgcttattgtagagtatatgatccaagaggatttgagtttgaaattaccattgaaaatttattatacattctcgaaaatgcgaattgtatcaagggtaagggacttgaaggagaatttatatatggatgggatggtaaggatttagttcttatgccagttgagtcacctgactataaacaaattgcggcttataataagattgtacataataatgaatctattaagacaagagacttgattcttggcgcaacatatcttacaaaagaaaatatcgaatggatttatatgggacgttttgaaacatacggttatggttatgaatttatacaggatggtaaaactgtaaaaactaaatcctataaagatattccaaatgagtcaactcgttttggatattatagtaagatttcttataaaagaattaacaatctctcatatggtaaaatgcattggttcgcaagattaagcgagggaaagtatgaatttgagcaattcaaaagtgttcctaaaaacaaacttattagttgtctcgatgacaaatgcacatctaaatattctgaaatttatgattcaatggaatcatcttatcaattctcccctatagatgatagcaaggataaaattgtaaatatctcatttgaagatttttgtgaaaaagcaattaatacatatgctgatgatgatataacaagaaaatatatcaatgttcgctttatgataaacaacgatggagaatatattaaatatgaaatgacaacgccatataggtcagaagataacggcaaatatactgtttataaatatagtgccaagaatatctatcatggagataaggaagcaattgatattttcccgacagaagaaagagaagtggaagtacgttatggtcaaaaagaaattcagacgcatatgattccagtttctattgaaacagtttttgaaaagttaaaaccagtatgtaagcagaaatatttagtaaatggtagagaatataaaaaggagtacgagtttaatgagtaaaaacgatgacagaattttagaattaaagaaacagattgagacaaagaagaaatcaatttcggagaggaaaatcagatttattcctgaaacaaattgtgttcttaatatggatggaatgacaattaatctcaatgtgtgttcagatgatgcattattattacttttgattagattgaattcatatttaatgtctgcaaaggatcttaatatggctgattttgaaatttcaggatacagtgtgacagcatggattaaagatattaagagcaagttagaggtatctggtctgaagaaagaagagtctgatttgaagaaaatggagagtaagttggataagttgctttctgatgataagaaaacagaactggaaattgatgaaattgctgctttattgaagtaaaagagagaataatacaataggtagtatattccgtaaaaatacatactatatatagtggttggataaatttaaactactatatatagtaacaaaatggacaagaaatatcggtttccttgggaggtgaaataaatgacttgtaagtatccaataactagcagaagttataaattttgtttaggctgtagcgatatagattgttgtgaagatgcagttacttctaatatacctatgccagaagttcagccaccaaagaatgttattccgtctgcatcagaagcaaataaaatgacaaacaatgcaattgatagttacactacacagcaattagcagagttatcaaaattgattagagatgcaattgcagatggcaaattttcaatcagtgaagatggctgtttaaaacctgaaacacgaaagaaattagaggaacttggttataaagttgaaactggtactcagtacaatgaaccatattacagtattagttggagagaaacgaaatgaggtgttacatatcggaaatttagtagaagagatgaaaaaatatgatgatgtagatgaacagacattgtggtggataaataaggcactttcatattctgggtatccaagtcatgtaggaaaacaaaaaataaaagaacatataaaggagattgaaacgatggagaataataaagtaagacagtttattgatttacttgtcaatgaagaagaaacaattgaaaatgcagcaaaggtatctggaattggtgatatgaaattagttgatgttttaaaaactatttcagagatggaatttgaaagtattaaggctttttcaagtgctgttgctggtatgaatagtatgaaggaagctattcatacagttaaggatttggatgatgcattagtagagctaaagaaatcttctgaaaagtagagaatatataactgtaaacaaaatgtaaattgtgaatctaggaggtgtatatgttaaagacttttgatgagttatctgacgaggaaagtttgtgtaaatattgttcagcaaccgattatggggaacataaatcgtgcattacaccaaatggatattattggtgcgaaggtgcgcattgtgaagatgcttacagagaatatttagatgataacgaaacaagtgaaaatgttgtgaaatatgcaagtaaagtaatacttacgaataaggaggatattgatgagtacaccactaaaatttgaattcgattttggagaggtgtttgaaggaattaaacaaggtgttattagagaattggaagaaatgaattttgatgctgcaaaagataatgctatcaatcagataaagagtgaaattaaatcaaagatagaacttacatacagtgacgaaagagaattaaaagacgagataaaaaatgaaatcaaggaaagagtttatgattcgattatcaaagaagtcggtgataaatacgctgataaatttaatgattatgtagaaaatcagttatctaaaaatccagaacgtctcagttcattacagaatattattaaatgcgaagtgagcgagaatctatatgaaaatttgtatagttctataagaaatgaagtaattggacaggttaaggatgcaacaacacagttatgtaatttaattggtaacaattctgtcaaggttaaagactctaataagactattagcaaagaagagtatgaggatttacttgatagagatagaaaattaagtgcattagaagcaggtggagttgataactgggagtggtatggagaatcactagctcagtattataacgaagaatagcacaagaattttcgatttctttggagtgaaaggagagaaatatataatgatatataattgtaagaagagaattatatatccacctaaaaattttattacgtataattgcgacagcaaaaaatacaaaactaatattttggttgatgagtgtttagcagatgaaatagaaagcttatggaataaagggattagaacagccggatgttgctgtggtcatggaaaatatcttggatttataaatgtttgtcaagatgacatagaaaaaatggaaaatttgggatatcaacattatatatttgaagatgattgtggtggagaaaaaagaaaagatacatttattccaaaaagttatgggcatatatatgacggatatattgatagtttccaaggataatgaatgaaaaattatatattggaggtgagactggttggcaaaacgcaaagagacattagatattgaagctgcattacaaaaagatacacgaattaagagaatatatggttgtgaggaaataacaattggtttttataacaatgggcatggaaatgaaatagttgactttatgacaatggattcaaaaggaattattaaatgttatgaaataaaagtcactattcaggattttaaatctgatgcaaagaaatcctggtatggtcattacaattatttggtggttggtaaagaattgtggaatgagtataaagattacatacttgaaaatacaccaaaacatattggaattttaggatcatctcttggaagttatcgaaaatgtaaaaagcaggacatatcgcaagaacaatcagaaatgttaaaggagagtatggttcgttctatgtattataaaatggtcaaatactacaacgcttccgacttagatgaaatcaaaagactcaatagtggtattcgcaagctaaagaatgatgttgaaaattacagagatagggtaacaaaagcagaaaatatgatttatagttatgagaattataaatcatataatgatggaattgatgattttgatttcaaaaaggctgtcgaagcagaaaagaaaaagtatttggagaatataaaagtaaagaaagagaggtacatatgagtaatttgaaggaaaaattaacaaaaggtggagtaacagcagttattgtcattgcaattttagctgtatgttatggacttagttggattgtcacatgtggaataatcaagcttattacaatgtgctttggtttgacatttaaatagtctattgcaactggtatttggttgattatctgtattttaaggtcagttttcaatgtaacagtgaagaaataaaagccgagtaaactgacatttcttgacaagattaaagataaggagaagtaaatgtgttctgatacagtaattgctttattaagcatatttgtaatattgagtatattatttgcaggattctatatatgctgcaaagcggatattgaaaatatatctattttcaattctataaagaatttcgttattgatttatttaaagatagaaatattttaggtaaatttctttcaatcgttatatttttattatctattccaggcatgttatttgtgtttcttttggcaatagtggaagtggttataaagttatttataaaaatatggaagttaggaaatagataaaactttatataaataagagaatatatagttagggggaaggtgagaaaaatgctaaagaatattgaagatattataatttcagtaacaacagatgacgaaaaattagagactttaaagcaatatgaagatgatatcaaaacagcgaaagacatcatcaatggtaaacttacatattgtgaggagtgcaaggactattatcttacaaaatctttcttttcagaaagagaaactgttcctacaaagatttgcgtgtatgaagatccgattaattcaggtggtaatgattatgtagatggatatgctgatattttatatagtgtttgtcctaaaggtcataagcatgtagttgatagaaaagagagaagaaaataagagaatatatagttggaggtgagaaatatgagtatggtgaatttaaatttacacacaattgtattggttgtgttatgtcacttaattggcgattatgtgttgcaatgtgattttattgcacagacaaaaggaaagaattggtatcatttatttgtacattgtgcattatattgtgttccattcttaatagcattcggttggacatggcagttggcagtaatctttatttcacatctgattattgatccgttgaaagcaagatggaataagattacatacactacagaccagacattacattatataatcggaatgctttatcttattggttaatcaaccaacaatttccaataaaaataaaaatcgaatagagaataaacatataaaggaggaaaattatgtttgcagaatttgaagatgatatacagttttggggatgcaatattccgaatgaagtgaaaatggttatagattcagcaaatgaaagtgtagacaaatcatttaataatgaagatcagaaacaagcttatcatcttggcgtagaaaatacattgtctgtattgaaacagttacttgatgaagggttaagtagagatagcattacattttattatccaaatgcagctacgacagaagaaatgaatatagaagatattaaccaatggttagaaacattaccatataaataaatcactgtttcattcggattttgaggaggtgaacatgttagtagttttaattttaatgagtattcatataattggagcaattattactattattattcattgtaaagacggaacaatggaacatgcttcaaaatatggagatggatttagatttgcaaaaccgtcagatgttatatttcaagattgcttactatgggaaattcaattagtaattcatacgatagtctttgtagaagattacataaacagtaaattcaataagcattttcattgaacaaatcagttcaaaaattccaaaaacaaaatgtcacgaataatatataaaatccgtgacaaaaagagaataaataaatgcggaaaacatttgtatgggtggaagaacagcatacccttgggtttgtatactcaaaaatcactgttgaagatagattttacataaatttattttctgtgttccgtcctttttgggcgtttagatagattgtttttattaacaatatttatataaatttttaattttaaggaggacaagtaatttggcaaagacaaaggaaagaaaagcattaaaaaaaggtaaggcagcattcaatcttattggtcgtgtaaaagtaacagacaagacattcaatcttgacaatagttatgattctggttggacagataacagtatgtatgtaggtgttgattgtggaaacggcaatacagtatatgcagagatgagaagtggtttcttccctgataaggataatgtaattcgtgcttacagtaaggatgagaaagacgatgcaggaaagagcaagtcagtagagattgcgtgggaggatcgtcttgatgagtctctgtatgatagcatttcagattcttcattcttaacagttggtgttgaaaaagatgtaaaggataagactgtatataagaagttcctcacagcttatgatgcagtagagtatctaaatgagcatcttgaggacggaatgattgtaaatgtaaagggtacaatcggttacagcgagtatgaaggtaatgtttctacaaagaaagaaattacatctattgtactttcaaaaattgacgatgaggcagatttcaaggctacattctcacagacaattcttgttgattcaaagagcattggcaagaagaatgatgataagggtactatggaactggtagcatacgttgttgactatgttggaaaacctaagattgacggagagaagattgaagttaagaagaatgtcacataccctaagacatttgaagttgctatcaatgagaatccagagattacagctaagatgcttcagagattttttaagcctaagaagggtaaaattactgagattacagttacaggtaatttagtagagggtggctctactgtgaatattacagaagatgatattcctgatgatattaaagaacttattgaaatgggactgtattcagaagaagaagcagagaagaagattgcagtaggtaatggcaatcgtgagagaagaatgattattgtaaagcctgacattacatatgtgggaactggtgacgatagaaagcctactgtagcatttgaagatggcaaatatgatgaagacgacctttatttctacgagcaagcattacttgatgctggtgcagaaccaagttcagatgatgatacagattcagagaatgaggaaacttcgtcagaagatgatgaccttcttgcaatgcttgaaggcatgaactaaaaaaaatacgcttgccctgtttaatacagggtgagcattttatcaaaagaatatatacattttaggaggacaaaaaattggcatttagaaaagcaagagaagcaaagattggtggaaaatttttagcatatggttatgagggttctggtaagtcatggtttgctcttacattcccaaaggttgcatgtatcgactcagaaacaggtattgctcactatgagggcaaggatattacattagcaaatggcaagacttacaacaatcttattttagtagacgacacatcagaccttgatgatttagaggatgatattgacgaagcagtagattcggatgagattcagacacttgacatcgactcggagactaagttttatgcaacaatgcaggttggagctacagaagttgaagagaagaaagctcgtagaaagggtggagatgttgatgatacagtagtttctcagagacagtggggacgtatcaaaattatcaacatgaagcttcagcaggctaagattgatctctctgcaaagggtaagcatgttgtgtcagttgcacaggcaacagaagtatatgaaggaacaggcgataaccgtaagttagttggcattaagcctgatatgcataagtcagttaaatttgattatgacacaatccttgagttctataaggaagagaatggtgaggatgttcgttattttgcaaaggttaagaaggatagaacaaatgtaactaaggttggacagattattgagaatccatcttatgatatttggaaggattattttgaatcaatgcatgatcttgagacaaatgagacatcatacaagaatgacttaaagacttctacagattctatggttgacaaagctgagaaagcagaagagttggctgctgaatttaaagatgtattaaagtcactcaaggataataaagatgctttgctcaaagtaaacaagcagatgaaggataaggacgtttcattaaagaatcttgaaatgcagtcaccagatactcttacagagttaattgattttgccaaattacagttagcctaattaaaattatgctccgacaggttaattgcctgttggagtttttaagaaaggatgatttggtaaatgagaaatataaaaaagaaagataacgagcagtggattgaactatgtgagtatgtaaagaaagaaattcttgaatacgatgataatatgaaatttccacagtatctcgcattaaagctacaaggtattaaacgtggcgaacatatagcgaataataatcatgaagcaaaagctaattatgatgattacacaattttatgtacttttaagttatgtaagagaaaaattgttacatatttacatgaaaatgaaaagaaaatcaaagatgaaaaacataaaatcaatcttattatgaaaatgattgaacctgaaatcaacgatgtatatttgagattgcagaatgttaaaaagactgaggagagagttgaatctaaagactttaataatcagagtaatgagaatgctggatatgtaaaaaagactaaagagacaagtgacagaatgaagaaactgttttgaggaggtactaattggctgaaaaaaaagagaataaaaaattaactccttatcaggaagaagtattaaaatgtgcaaaacagattcgagaatacaagataatagcagaagctaatatagttgctattttatataaacaaccggaattaatttttgattatacattgcagcttgaagattttagtgaaaatacatggcgagtctattggcagattgcaaatgacattattgtagtagaaaagaaatcagtattggatgatatgactgttggtttatatcttgaaaagcatcaaaaactcaaaaaggaatatgaggattatggtggatatgaaacgattgataaagccaaagagtatgtaaacatcaacaatatggatgggtatgtcaaagagctatacaagtggaaaacagttttggagatgttaaaaaatggattccctgtaaataatcgtatcaatgaattctgtgatatgtctttagatgaaatatatgaagaatatgaagcaatgttaaatcatattttcatcaatgcagatgatgatgtacagtcatattcattagctgatggcatttatgatttaattgatgaattagatgctggtgcagcagttggacttccatacaataatatggatattcttaataaagaaactggtggtcagttacctggtaatattacattgattggtggattatctaatatgggcaaaactacactaacaagatcaatgttgattccaagcacaataaaatatgaagaaagacttgttatttgtgtcaatgaagaggggaaaaagaaatggcagagagaattgttggtgtggactgcgaataatatttacaaacaagatttgcaaaaattcgttgttagagatggtaaatattctagcgaagttaaagatttgttaagaaagtgtgcagattggattactgaaaaggctgagaataacatgcttataatagttccattcaaaagatacaaaactcagaaattcataaaagttctaaagaaatatgcaaaccttggtgttaagtatttcattcttgatacatataaagccgattcaggtagtcgttccgacaagatgtggttagatatgcaacagaatatggttgatatttacgatactgtgaagtgtaaagaagagggtggcttggaagttcatgtaactattacattccagttggcaaaatcttcagcacgtcagagattttatagtcaagataatattggtatggcaaaaagtattgtcgatcctgcaagtacatgtttaatgctgagagatgtatttgaagatgagtacacaggtgagaaaaatgctttaaaggtatatagatttgatgggaaaaacaataaatcaaaaatacctgtcaaactggacaaagacaaacattatcagcttatatttatttgtaaaaaccgtgagggtgctgcaagtagtatacagattgtatgtgagcatgatatgagtagaaacatactgaaagaagttggttttacttctgtcccagttgatttttaaatttgtgatggaggcggtgagcgtgtattaatgcagatgaactaaaggaatacattatagagaataattgtatagaacagattttattatcgttggagtgtcatggactacacgaatatcttcatgaatggagagccgccttaccacaaggcaataataagactgctatatgtgtaaagaaagatacattatcagtagcgattagaagttcggaagaaaataaacgtggagatatttttacattggttatggcaataaagggtatatcttttgggaaggctaataaatatctccacaatattttaggtttgaaatattcatatagtaagagtgacaacaaagataataagaaagatccattagcaatcttcaaaaaggtgaaacgccaaagatacacaattgataaagatgttccagtatatgatgattcatgtatgaaagaatatactgatttaccatatattgattgggttcgtgaaggcgttatgccttttgcatgtaaaagatttaacattggatattcatatgatagaaaacgaattgtcattcctgaacgaaagtgggatggagatgacaatgaatatataggtattagtgggagaactactgtaccaaactatgagatgtttgatattccaaagtttttcaagttatccaaaacatatccaaaaggaataaatgtatatggattaaatgagaattatcaaacaattcaagaggctggttatgcagtcgttttggaagcgcagaaatcggtgcttaaaaggtattcacgaaaagatggtacggctgttgcaataggaaattgtgagcttacagaagaacaagttaggatactgattagtttaaatgtagaaattgtagtggctttagatgaaggaattgatataaaccatattagacaggaatgtgataaattttatcctattagaaaagtaagttacatatatgatcgttgggatttgattaaaaaaggtagtaaagacagtcctgctgatatgccaaataaagtatacaacttccttctcaagcatcgtgttttatatgatgagtcagaaaggagaaagttaagagattggcaagaaagacaagtaaagaattaacagaaatttgtaacaagtttggtgttgatacattatggtcatggtcaaggtatcattgctacaaacaagatagatgggaatattttttgaaatacatcctacataagaaagaagatagaacaaatagtatttattgtgtatctggtggtaatgtacatgatattattgagcagctatatactggcaaaattaaatatgaggatatgccagatttatatgaagatagcttatttacaatgaattgtgcagaactcaaatacaatcgtagtgattctgataaaaatgatgcaatagcaaataaatatgaaaattgcattagacatttctttaaaaatcataatctgattacttttccacataaagttgagcattttattacaattaaaatttctgatgatatttatatgcaaggatatattgacatgctttatatcgagtcatacaaagatgaaaatggcaatgagaaaaaacgtgtacatattgtagattggaagacatctacacgttatcaaggcgcaaaaattgacgctgaatgtggtcagttggttatttatgctgaaggtattagacaagcattaaatattccattggaagatattgtatgcgaatggaatttcttaaaatatgtcacagttaccattgaacagaaaaatggtaagaaaaaagatagatatatagaaagaaattctataggcgaaagtcttatcaatacggcaaagatgtggctgaaaaatttcggatatgaagatgatattgataaatatgttgatgagatgatattaaacaacaatattgattgcttaccagatgaggttagagaaaaatttgaaatccatgattgttatgtacaagtacctctaacagaagaaaagattaacgatttaaaagaagacattatcaatacagtcgaagaaattaactctaaagagagagaatataaagatagcaaagatgaaaatatcttttggcaagaagtgacagatgccgatgaatttagattggcaaccctctcaggatattctaggtcgttgcataaaccatatgaccagtatttaaaagagaaggaattgttcaaaggagaagctgaatctgattccgatacagacgaagatgatttattagcatttgtaaatagtttatagacataggtaggtgagaagttgagtaatttaacagtattacatttacatagtatggattctaacccatatagcggtcttgaagttgactcaatcacaccttttcaagcttatattgataaagcaaaagaagaaggaatgaaagccattgcttttacagagcatggcgcagttcttcataatgttgcaaaaagacaggcatgtgaaaaggctgggttgaaatatattaatgcagaagaattctatgtaacagaaaaaattgatatggataatctgcaaagagacaattatcattgttgcttatacgcaaagaattatgatggggtattagaacttaacaaactttcttctgattcatttaatcgtaatgatggtcatttttattataatccacgaattaccttagaggaacttgagaatacatcagataatattttagtattaacagcttgtgttgcaggcatgttatgcaaaggaacgaaagaagtacaggaaagatttctgaaattccttattaaaaataagcatagatgttggttggaaatacagccacataattttgacgttcagatttattacaatcagtatttgtatagaattgctcagaaatatggaatgaagcttattgctacaaacgatgtacatgctattgataaggatcatatgatgggtagagcagtgatgcagaaatcaaaaaatgttaatttccatgacgaggatgcgtgtgatttatcatggaaatcttatgatgatatggttactgcctttgaattacagaatgcattacccaaatcaatttatcttgatgcaatcgaagaaacaaatagattcgcagataatattgaatcatatgaattggactatagcaataaatatccaagattatatcctgatgctgagaaagaatttaaggcacgaatagttcaaggcgtaaaagaacgtgggataagcaaactcccaaattataaaacagagtatattccaaggatacaggaagagttagaaacatataaacataatgacgctattgattttatgttactcgattcagattacaagaattggctgctgaaaaataatatgcactatggatgttcaagaggttctgtatctggtagtgagattgcatatttgattaaatgtactgatgttgattcagttaaatataagcttaacttctcacgatttatgaatcctgaaagaatgtcattggctgatgtagatactgatatttacgcagaagatagatataaagtgcgtgagtatctatttaataaggaaggtttgtattgttgcaacattattacttttaatacaattcagttaaaagcagcgataaaagatgtcggtagagcatatgggatgactcctgatcaaactcaggaattatcaaatatggtagaaactgatgataaaggcaaggattatatgccagaagaaatcagagaacaatatccagaaatgtttaaatatattgatatggtaattggaacaattacatcacttggcagacatgcagcaggaattgtttgtagtcctacagatataagatatgattttggaacattgtctattacatcagatccacgtcctgtaagccaaatagacatgcacgaaattgattctttaaattatgtaaagttagatttgttaggattaaatgctgttggactaattgatggtgcttgcaaacttgcaggtatagactatttaacacctgataaagttaatttctcggatgaaaatgttattaactcaatagcaaaagatactacattgatattccagtttgaaagtggttttgcaagtgattcattgaaaagaacacttagtaaggaaactttggagaatattaaagcacagaatgataatatctcatatcttgatgtaatggctatggttagtggtgctattagaccagcaggtgaatcttatagagaacagttattcaatggtatttataaagataatggcaatgaagcacttaataatttcttgaaacctacgcttggttatttagtatatcaggaacagattattgatttcttacatgacttctgtggatttactatgggacaagcagatattgtccgtaggcattttgctaaaaaaacaggtactgaagcagatatacctattattgaaaatggtggatatatggtagacattcatggcaataaagatgatagatatatcccaggatttattgcaattgcacaagagaagtatggtatgaccgaagctgaagcaagagagactataaaatcattcttggtagtaattgaagatgcatctaattatttattttcacgaaatcattccgttccatatagtatgataggtctatttattggatggttaaggtattaccataagattgagctattaacatcagcattgaacgtttatgtagacaataatgaaaaaatgtcaaacatcaaagaatatatcaaatcacagggaatagaaatcaaaggaataaaatttggcaaatccaaagcacagtattttatggataaagacgaaaatgccatttatcaaggaatctcttctataaaatattgtaatgatcagattgcagacgaattatatgaattgtctaaaaatcattatgataattttgtcgatttactttctgatattattttaaaaacatctgtggatgatagacaattacatattcttacgacactaaatttcttttctgagtttggcaaaaataaatatttactgtcaattattgatatgtacaatttgttaggaaaatgtaagacgctgaaaaaagataaaattgtatcactgaatattagagaagaagatgtaagaaaatgtgcagagaaagagacacctaaacagtatagcaatgttgataaggtcaaacttgtaaaactaataataagtggtttagagaataaagctttatcaataaaagaacagattgtatatgagcaagagtatcttggaaatataatgtacaaaaatccgaaagcaccaaaagatatgtattatgttcttgagtgtaagttctataaggataaaacaaaaccataccttatgctttataacatgagagatggtgagtatcttaaaacaaaaatcacttctggaaagtcattcattgaatctccatttatagcaggcaatgtcatcaatgtaaaagaatttggtaagagaaataaaatgaagaaggttggtggcgattggattaaaacagatgaaaaagagagaatagtaaagaagtgggacgtatattagaaggagatgtaaagttggataaaataattgagtttaaatgtgtaccagaaagacttgtatataattctactgacttcaaaatatatggcgtttctgtcaattcatttaaatatcctgatgtacagattggaaaatatggcacagcaactattaaaggtaatatttcagaacttaatcttggtgttgattacattgtaaaagcaaaggaggtatccgattctcatggagtcggatacgatgtaatcaatattaaaagagagaaacctactacattagttgcgacacgaaatttcttatatgaaattcttacaccaaatcagacagatgtgttattagaagcatatccagacatcgtagatagaataatgaataacagattagatgacattgatttatcaagaacaaaaggtatcaaagattacacatttaatgttattaaaaataaagtcatagaaaactttaaattggctgagattgtagaagaattcagagggttatttaagctctcaatagtaaagaaattgtatgacaaatatacttccgttgacaaaatcaaagaagttattagagaagaaccatatcagtgtctttgtaggttaggtgggattggttttaagactgctgattctctattgttggcattggataaggatggtaaagaatgtcagaagaatgggaaaaaaccagttttgttctttggatttgatcttataacatcatatcagagagcgaaagcttgtgtagattatctacttgatgagaatgaaaataatggtaatacatatatgcatgttggcgatttgaagaaacagtttgatgtattagttccagaagcaaaaagtaatttacctcttattctcaaaagtgataatgatgtggtatttgacagagagctattaagcgtatgtaaaaaagaaacatatgaaacagagaaatatatagcagagagaataaaagaaggattgcagatacatacaaaatgggagtgtgattgttcaaagtttcaggaacttgatggttttaaactaacagagaatcagtgtaaaacatcacaatatatgtgtaaaaataacattgttcttcttgttggatatggtggcagtggtaaatcttcaagtacacaggcatttgtaaatatgttaaatgcttataacaaaagacatttacttttagcaccaactggtagagctgcaaaggtactgtcaggttttacaaatgaaaatgctatgacaatccatagaggtcttatgtatatgccacctgctgattggggatttaatgaagagaataaattaccatacgatgtagtaattgtggatgaattttcaatggtagatatttttcttttcagaaaattgcttgaagctatagattttgaaaaaacaaaattacttcttattggtgatgatgcacagattccttctgttggtgctggtaatgtactttatgatttattgaaatgtgaggatattcctactatcacgcttgataaggtattccgttatggtaaaggtggtttatctactgttgctacagatacacgaactggtactgaatatttagataagaccaaaacaggtatgcaagtatttggtgaggatcagtcatatatatttatgccgattcttcaagataaacttgtgggatatacagtaaaactttatcagacattgttatccaaagggtattctgttgatgatattgcagtcttatcttgctataacgtaggtgattatggaacagtagcattaaataagaagatacaaaacgcagttaattctaatccaaaggcgaaaattacatttggagatacagaattcagattgaatgacattgtaatgaactatgctaatgattacaaagcaattatctataatgaggaatatattgatgataaaaatacaacatttattgctaatggtgaatctggtagagttgtaaaaattctaaaagatgcaatggttgttgattatgatggaacgcttatctatatcccaaaaagttctatgaaaaatattcgattggcttatgctatcagcacacacaaatctcagggtggtcagtttaaggtggttgttttaattacgcctaaagcacataccttcatgttgaattccaatttgttatatgtaggagaaagtagagcaaaagaaaaatgttatcaccttggagagattcgtacagtaaataatgcacttaaaaagaaggaaaattttgatagaaaaacaatgcttcagatatttatgaaagcagaataactgtagagaataatacaatagaggatttctggaatacccataaatagggcgtttcagagactcaaaaagcaaaggaaagacggattttatgccgttcttaacacaatatatagtggtttgataaacactcaactgccatatatagtacataacaaaggagatgatactacatatatgaaattttatgaacgattagaacactggtcatatttattaaaatcaaaagcattatatcatgagctgaaatattatgtaaagaaacgacaaacacacattaaacgattatatggttttaatagtagagggatcggtaaaacatataatctgatgaagatcagtggtaaatataaaattcctgttatcgaaccgatgggaagcatggcagattatgcatataaaatgcacttaaaattcaatccaattgtacttacaccaagtcagttgagagggagagtgcagccaggaacaattatattggttgatgaaaaacaattattgaatgaaaatgctaaatttgaattagatagatatatacaagttggatttgaaacagagaattaaatataaggagaatactttatgagttcaaaagacaattcatatgcaaatacagacaaaaagacattatttttatctgatgatgtagacaacgaatctattggtaaattaacatggagcattttacaacagattcgagaagacgatgagaaagatgaaaaagagaaagattataagcgtgaaccaattaaactatacatcaactcatatggtggatctgttagtgatatgtggggattaattgatgtcattcttaatagcaaaactccaatctatacatattgtacaggatatgcaatgagtgcagcttttaagattttcttagcaggacataagagatattgttacaagcattcgacatttatgtatcatcaaatgagttgttggagaagtggtaaatatcaggatttggtagaagacagagaagaaatggactggctgaataaaaagattgaagaatatgtaatcgacagaacaaatctcacaaaagatgatattaatgagattcgtgaaaagaagaaagatttctatattcattctgacaaagcagtcaagtatggaattgttgatgaagttttgtaaagaacagagaataatacagtagcaagctgatttctcgtgggaggtgaatcatgagtaaatcaaagaaagaaataaaaaaggaattatatgagtatttttcatatgtgcagcaagaggataataaatcacttctgggaggtatggcttgggacgatattgcttggcatatcaaatatgcagaagataatggaatattaagaacacagctaggttttgattttcctaaattgcttggacatctgattattgatgatgaaacatatgaaaagaaaaagagagaatatactgaaagtattgaaacttataaccataatgcagacttgttaagagctaataaatggaaatataagctagtcgatgattcagaagaaagcagacgacatttggctgatacatatattcagtatgcagaaaattgtaaagaattactaaaaaacttagatgtatatcacaaagaatatttggattatatgaaaaatactaaacaagaatcgacagtttcttgtgaaaattaaggaggtaataaatgagagtagcattaacaggtcatagacctcagagattaggattgccagatgatgagttagatattaaatggacaagaattggtcattggatttttaatcaaatacttgatgtgtctgatgtttattgtggtatggcaaatggctctgatattttaattgggttaaatacttgtattattaaggagagatacagagcagcttcgccagaattagagaaaaatagaaatttaaaattgcattgcatattaccatgtaaaaactacaactcatctaacaaatattacaataagttaagaactgaagctgatgaatgggttgaattatcagatgaattctataaaggttgtgataatgtgagagatcaatatatggttgaccattgcgatgtacttcttgcaatttgggatggtaataaatcaggtggtgtatggtcaacaattcgtaaagcacagaaagcaggtaagaagattatttactgcccaaaagagattttaaaaggagaataatatagtaacaagaaaccattatttcatgtggagattaggagcaaaatatgacattagataaagaaacgatgaaagtaagcacagcattaagaattgcaaaacagtattatccacaggataaattagaacacgcacttagagttgctacatatgtatcagaaaatatctttattccatacgatttaagaaatgagtgtgtggctttggcaattatgcatgatcttgtagaagatacaaattttaaatcatctggtttgccagataatttcaaaaacgcattattactcttaactaaaccagacgatctttcgtatgatgaatattgtcagaggtttaagaagtataacacaaatgattatttgtgtgcatattgggttaaattagccgatatgaaagatcatttgtcactaacagatacactaacagataggttaaaagaaaagtatctaagtggattgagatatttattatagaaaggggtaaatatgaaagtaattttacagtatacagattgtatgtctgatgataagaatatttttggagtattagctagaaacaatgtagaagtaattgaaacgaaacaaggacagttttcagtttatccacttgttacaattagagtcaaagatacagatacactcaacaaaattttagagcaactaaatgagaaatcggtttatggagttagaattgtaaaagtaaaatcagataaatcatttgttgaaagattaaagatgatgtttgagtaattttgaaaaataaaaaaggagaatacattaatgaaaaatatcgcaacgacaattgcttatgcatctgcatggattgcaacatcaatagcagtaatttttgcaattaaatatacagaatctgcttggtgtctctgggcgttattgtttcctgcttgtattaaagctagtgttgatattagtacgagcaatgacggtgatgataacgaagaagattagactattatttcatgtgaaaggaagagatagatatatgggaataagatatatgtgtaaagaaagagaagataatttaattgacatcaatgtatatggtcatggatgtatggagggactatataactgtgaaggtagattcaatacaaaacatgtttttagtgatggattcaaccctgatagtggttggtatcgtatagctgattatagagtaaatgacttgaaagtttttaggaagaaaggaattaatattacatacgatgatagttgtaaatacgttaaagaattagtagaaaataataaataaaaattcacaggaatctaaactttcttgcgatttaaaaaaggagagtaaaatgagcgcagataacggaatttatattttaaagacaaaagatcagtacagagtggcacatctttgtgctattgataatgtaacatggtcagtaattgacggtgactggtgtactgatatgaataagagaggaaaacttgttccaactagagttgttgaaatgtggggaaattgtaaatatacaagaaatgaaaacaaagcatttgaaattgcacacaaatgggctagtagccttcctatatgtgaatatggagtgaatgttattacatacaacaagacatggaaacacattgtagaagatgcaaaaaagtatgcagaaaaagaaatttattttattaacaaacaaggaacagacgaaaaaaatgagtggtataagtgccagttagaacgcttgcaaaaaattattaatggagaatattcataaatataacttataagctataatataatatgcttcgcatatcttagagcaattcgctcattattccacaaggaaaagagaataaataatcaggaggtgaacatatggttgatatggttgcagaaccagtttgtttcaaatttattatcaatacaaagaaaaataaaacatttcagatggaatggtatgtttattatcatgattccaatacacaaaaaattattaaatggaatgtatttaatcatggtacttttgcagaaaaagttaataagttattacaagaaaatttgtcaagagatgaatttgcagatggtttaaaaaaatatcttatgtattatttttggtctaaatgtgaatatgaaataattttatcaccttggactggacaagcagatgatattaagattgatgtttatgaccaaataatgatgaattttgataggtttgttgattatgtttggcagtttacaaaataaaaaaataaatgtttattgtggttggtatagaaatacagttgttaaacaacgacctgtaataaaaaaagattttgtgtttcaaataaaatgtttggaatgtaatggcagtggaattttcgattgtggaattaaagaagaaaacgaaacttgtgtttcttgtaatggaacagggaaacaatatattggaacaatataacataataaatgattttttcatatgaaaatacattaggaggactaaaatgaaacaggcgagtattccattatatataaggtttggtgaaataccaactgacgaaataagtgaagtgcatagaggagattcagtaatcagagaggaaggaggagtgtctgtatggagagcagttgagtctaatggattgtattatcctatactcccagaaaaccccaataaaaatgcaatagcggattattttgttttattattggaaagtgataaaagcgtttatttagtaacgggagatgaattgttcattgaaggtgccgacagagaacctttattaaataatgtaaaaattattaaagaaatcacaaaatattatagaaaataatttgaataaaaatataggaggacaaaatgggaacaatcacaattttaccagaaacaacaaagaatccaataacgctaatgggacgaagggcaggatgttgttggaatgcaaatattacagatgatgaaaaaaattataagcgtggtcttgattgtatcaaatcagctcatggaagagtaatggaatatccaaatgttgaaatgattatagatggatattcagcaaaaacaatccgagaatattacactcatattgttggagcaagcagattacaggcaagtacaaggtatattgattattctaaaggaaacggatttgattatgtaacaccacaatcaattagtaacgatgaagatgttgctgcaacatggcatagcgttatgagatatattaataccaatattcagcatctcataaataacggagtaccagtcgaagatgcaacaatgttactcccattagcttattgtacaaaaatggtagataaacgcagtttaagaagtcttattgaaatgagtagagttagaatgtgcagtcgtgcttattgggagtacagagagttattcaaagacatttgcaatgcattaagagaatattcagatgaatggaaatgtattgtagataatcttttccatgcaaaatgtgatgaagttggatattgtacagaaagcaagtcgtgtggtagaaaaccaaaaagaaagtaaatgtaagattaaaaattattacatgagaaaggactaaattatgcagtttttattatcagaagaagaaatgaaacaaggctttcctctgctttatagttattcgacagagcttccgacggaagaggcttttgatgaagaaaagaatttgaataaccaaggattctttacatatatggaagatataggacgaggacagtgtaaaattacagtatttattaaagataattaggagggattgaatgaacaaaagcgatattgcagaaagagtgaagctgcttaataaagcatctgacgcttattataataaaaacagtccaattatgagtgattatgaatttgattgtaaatttgatgaattgaaagaatgggaacgaattacagggattgtgttagcaaatagtcctactcagaatgtcggatgcaatgtagtgtctaaattagaagaaattattcattctcatccgatgttatcactcgataaaactaaatctacagatgatttagtgaagttctctaatggtagagattgcgttctttcgttgaagatggatggattaacggttttaaacacgtatgaatacaattcattaaaacaaagtgaaacaagaggaaatggcgaaataggagaagtcataacacacaatgcgagagtgtttgaaaattttccaacacaaatacacattgatacgccttttgaagttgaaggcgaagccattgtaacagtcagagactttaaagcaatcaatgatcctcttgttgagaaagcaaagcgtgaagctcaagggttaggtttaactggaaaagaatacacagattacataagaaataattctttcgcaaatccaagaagttatgcttctggttcagtaagacagcttgatagtaaaattgcaagagatagacacattcattttgttgcatggaagattccatttggtgtatcaacatataccgaaggattcggaattgcggaaaagcttggatttgaggtagtcccatatgttacatacaatagctcgtcagatgatattggagaaaaaattgaacgattaaaagctattgctgaagaaaaatcgtatccgattgacggcttagttatttcttataatgatgtagaatacggcaaatcattaggtataacagggcatcatccaagacattctctggcttttaaattttatgatgaagaaacaattacaacattaagacatgtcgagtggacaatggggaagacaggaattttaacacctactgccatattcgattcagtaaaaatagatgggacaattgtgagtagggcatccgttcacaatgtatcaattttgaaaaaattgcaacttggaatcggtgacgagattgctgtaataaaagcaaatcaaatcattcctcaaattcgagaaaacttaacaaaaagtaatacttgtaaaattcttgataaatgcccgatttgtggtaaacctacaagaattgttaaagagaatgattcagaagttcttatgtgcgaaaatccaaactgtaagggtaagcttttaggtaagttggttcacgcagcaagccgaaatacattggacatcgagaatttgtcagaatcaactattgaaaaattcatcaatcttggttggttaaattcaattaaggatatttatcatttatcagactacgaaaatgaaatgaaagttttagatggttttggtaagaaatcggttgaaaaacttcttaactctattgagaaatcacgcaatacatctttggaaagattcatctatagtttatcaatcccatcaatcggaaaatcagtaagtaaagatatcagtaaattatgtgaagagaattttaataattttgttggtttgatgaaatcttcaccagaaaaattattaaccattaatggttttggtattacgatgatgaactcaatgacgaaatggtggtatgagaattcgttgtgggtatatgaattatcaaaagagtttacttttgaaacacctaatatagtattagaggaaattccaaaaacattaaatggtaaaacatttgttgtaacaggttctgtcaatcattataaaaatcgtgacgaattgaaagccgatatagttactcatggcggtacagtagtaggatctgtaagttctaaaacatcttatcttattaataacgatatcaactcaacatcatctaagaatcaaaaagcaaaatctttgaacattcccattatctcagaagatcaattcttagaaatgattcattaatctttgttttcaaacagagaatatatctatgtaacaaatcaaaccaaaatccattatacaacataataaggagaccagctatgaaaagtcaaccataaattagtaaaaaatttctttttcatatcggtggtaaaaaagggtaactttaatagagctcccttagggtgctttttcaaaatctatcgatattggtatacagacctcttatttgaggttaaattcgacattgtcggtgagcatcttccagatgactctgacaagtttgccggaacaatgcccaagtgcattgtaatgagaccggccttcagccctcttggcatcataataagccttgaaggttgcgttgtttctgacaacgttccaagctgcatttacaagggcatatcgtaatacacgagagccacgtttggacatccttgttgtcttagcctgaaagttaccagactgataaacagaaggatccagaccagcaaaagcaagcagcttgtttggattggagaaacggtgaatatcacctatttcaccaagaatcattccaccattgatataaccgataccaggaatggtcatgatgacagaatcgttgaatttcatgatatccgtcatctcagcttcaatcttttctaattggctatccagtaactcgatttgttgaatggtttgagttatctgaatagatatagcgctgtcgttagcaccgacagacttctgtgcgagaactcttaattctttggcctgttctttggtaaagtgtccgtgtgagttcactttgagcagatttgccagatgagtcatatgcatggaagcaatctcttttggagaaggtgcttcttttaataaagcatagacagcgtgttgatgcagaccggatttgaaaaagtattgaatctccggaaagacctgatcaacataggttgtcagttgaattttcaatcgggtacgttgctttatggttttctgacggaaacgtcccaatgccttaagatccatcatatcgagatcgaagaagctgacgaatctgaggttgtcctgcatcataagagttttagcaatcacgtaagtgtcgaccttatctgtcttagttttgcgaacgttattttttcgcatttgacaggttttgatggggttcaacacacacacttggtaaagctcagtaacaaggtatcgaacaaggttgtcaccgtagtgtgccgttgactcaagaccgatgatgaggctgttcttatcgaatgattcgagtttagagaccagcagttggaagccatcagcgtcatttgtgaatttgaacggctcaatgattatttcaccgtcggaagaaatcgcagcggcgaaatgattaagtttggcaatatcaatgcctacgtaaattttcatgaggttgtacctccctttcctaaagtctgataccatgatgtccaccaacgattatcatcgtagacttgatagaaataagtactctgagtgaaaaacactccggcaacatccagctaataaacaattcagataaaggtagtggcaatacactccagttgagtagtcaagctacagaaaacaaatcaaaagtccatagtatctgaattgtattgaaccacgatattaaaagaaaggaaatatgtgataattaacttcctaattatcatacaagaaataatgaaaaaacggttagcaattttagcatgtttgtttgctgtatcttttcctgtcgtccccgtttggggacaggatagcagcattttaaaagacaacttagtagcaggcataacagaagaaatgaatttggttatagaagaatctatttctaaagcacaaattgatattatatcaaaacaacaattagataaaattcaagaagccgtaacgaaaataaatgctttagacacttctgatacaaaagaatggtttaagaattataaagaaattgaacaagaatactctgaatgggttgatcctgatgagtctatttatgattattttaattcatatgagttagaattgttattcagaatagtagaaactgaagtgcgtggagatacatattttgacgaaaaggtaaatgttgcaagcgtgattctaaacagaatggaacatgacgatttcccagagtcaatgcatgatgttattacacaatatccacaattctcaagttatacaagtggtgcttacaaaaatgtaactgtaacagaaacaacaatattggcttgtgaatatgcatttcagtttagggatacaacgaatggagcattatattttgattcaactaatggtaattcatgggctgataaaaatagagaatttttatttaaagatagtgtcggtcacagtttttataggtaaggagtatttatgttaaacagagagaaatatgaaaaagagattttagatatcgtgtgtaatgggaatagaattgcagtcgtggatgggaaaccaagagaatgtagaggtgtaaagtgcaatacatgtggtcttgagaagtttggctcttgctatgatggtcttagagaatgggtgaacagcgaatatatcgagccagttgagccacctgtcgattggagcaaggtttcggtagatgcaaaaattttggtacgaaacaatgaagatagtgtgtggaagcgtagatattttgcaaaatatgaagatggaagagtttatgtatggaacaatggtgcaacatcatggagtgtttctggtttgtttgctgtaagctattgggattatgccaaactggcagaaagtgagggaaaataatgaaaacagaatttactttaaatttagacagtcttacagacttaaataattttgtaatggaaatctggacacaaattccatgtgatgtagatagaaaacatgggagacgtattgttgatgcaaagtcgtatttaggaatgattggaatttcgatgaatcctgtaacggtagtaattaataccgataatgaggattatatcaaaagattcaacgaaatttgcagcaaatataagattgtggaggaataaacatgaattattcgcaggttattgacttagacagtattagaattagtgacttcttaaacggagattttacggaaagtaaaacggctgtcattgaagatggacatattgtacagattttagatgaaaggtggaatttataatgcttattttaatgggaagaactgcatctgggaaaacattggtgagagataagcttgtaaaaaaccatggatttaatagtgtcataacttatactacaagaccaatgcgtaaagatgaaattcctgatgttacatatcattatatttcagaagaagattttttacagaaagttgaaagtagtttttttgcagaatggaagaaacacattactactgaaggtacttggtattatggatcagcaaaagaagattgtgaaaaagcagacgaaaactctgtaattattcttacacctgatggtattagagatattcaaaaattaggatacgatgtaacggttatttatttatattcaaatatttcaactatcaacaaaagattagttgctcgtggagataaaaaggaagaggctgaaagacgtatcaaaactgatatatcagattttaaagatgcagaaagtcttgctaacaggattgtttataacaactttgatgagaatattgatgacgtggtaaatagcgtattgtttcattatagaaaggcgtacaaatgaaaaataatggcttaacaatttatttagctggtaaaatggcaggattaagtatagaagaacaaataacatggagaaaatttgtagcagcagaattggacaaatattcagatatggcaaattataaaactaatgttatttctccatgtgattatttcaattttgaagaaccaagataccaaaacgaacaggaggttatgaaatttgatctaaacttagttcgtggcagtgacattgttattgtaaatataaatggattaaatacaagtattggatcagtgattgaagtatacgaagcgtggaaaaataatattcctgtgattgcttatgatgaacgaggggattataacttaatccatccatggttaaaatgttgttttacaagagttgaatcgtgcgcaatggatatgtgcgaatacataaaggatttttacatgagataggaagagggtgagtgaaatattttttaatggattaaatacaagccatatggttgcaagagaattgttatctaaaccagatgaatttataacagtaacagttggaaatagagaatatagtattagtcatacgaaaatgataaaaacacatgcaaatgttgacgatggtgtgatgcacaaaacattggtgtgtgaagaattagagggaaacattgtgaggtaaaaatatggataattataagacgtcagatgttaaaattgattttttgacaaaacataataggaaattacttattgaattaatttgtaatgaacagactcatatgattgtaaaagatcatactaaatatgaatctgataggtacaaagaattagaagccttaaagataaaaattaaagatatgtgaggaaatcatatgccaaatattacaatgtgtagtagcgaaaattgcccaatgagaggtagttgttatcgaagtagagccaaacctgataagttacaaagttggacaaactttgaatatttttgtaatgagaacagtgggttcgatgaatacataaaaatatatcaaaataaaactaaaataaatcaagaataatggttataacttgatctatcttatgctaaaaatacaaagaaaggttgatttcaaatggaggtaaaataaatgttagtaaagcaacctaatggattgtattgtttctacgatggtatgtatgatgtacctataaaatggaatattacaaaagaacaatatattcatatggctctaaagaaagcaagaaaagaagctctgagtagcttagaacatgctgaagatattaaaatggtatatgacggatttttacctgatgataacatgtctgagaaacaatttgacaaatttctaaaagaaattggcagtaatgagacttatgaaaatattcataaatatgattgggattgatatgccgattaaattacattaaaggagaaataaaaatgaatgttagtaaagcagaatatgaagtcaaaacaacaatgacaaatgatttattaaaagcagaagagtatatcaatacattgggcgttgctacaagaaatccagataacgatgatgaattcagaagtatgtacgatgtgttgagtgacattgtgacagtatggaacaataatccaaccattggcaaagatgtagaagagttcttagctggtaatcctgagacttgtgatgaattacatgaatttctaaaccactataatttggatggaattatgagaaacagataggaggatatacatattgacaaaagtaaaagtaattcaaagagattgttcagaagctgattttgataagtctaagatctcaactgcaattcttaaagcaatgaaaaatggctcaggtattataaaaccaaagattgcagaagatattgcagacgaaattgaagaagagtgtaaggataaagacgaagtaagtgtctctgatattgaatcaatggtttatgataaattaatcaccaaaaaacagagacttactgcaaaagcatatgaaggatatagaagtattcgtgagtttcagagagaaaatgagaatacaacagattccgagattgatgaactgttagatggcgaaagcgaatattggaatacagaaaattccaataagaactcaaaagtattaaatactcagcgtgattatatggcaggaattgttagcaaggatatttctcgtagatttttgcttccaccagaagttgtacaagcacacgatgaaggaattattcatttccatgatattgattattttggtatgaatgcaatgagtaactgctcacttattaatctcgaagatatgttacagaatggtacttgtattaacaaggtaatgattgaaaaaccacatagatttattactgcttgtacaatcgcaactcagattattcttggtgttacgtcacttcagtatggaggggctacaattactcttacacatttagcaccatttgtaagagatagttacaacaaatactatgagaaatataagtcatggggattttctaatgaagattgtaaaaaatatgcagaagctgatactaaaaaagaagtagcagatggcgttcagacatttaactatcagtgtaattctatgtctaactcaaatgggcagtctccttttttgagtgtattcatgtatcttggagagactacagagtataagaaagaacttgcaatgattattgaagagtttcttaatcagagattacttggtcttaaaaatgaagttggcgtatatgtcacacaggcttttccgaagcttctttatgtcttagaagaagataatattcatgaaaattcccattattggtatttaacaaaacttgcagctaagtgtactgcaaagagaatgaaccctgattatatttcagagaagattatgaagaaatataaagagggtaactgtttcccgtgcatgggctgtcgtagtttcctttcaccttataaagacgaaaatggtaattataaattttatggaagactaaaccaaggcgttgttaccttaaaccttgtagatgtagcattgtcatctgaaggagattatgaaaagttttgggatttaatggaacagagaacagaattatgtcataaagcattactttgcagacataaacgattagaaggaacattatctgatgttgcacctttattatggcagtatggagcatttgcgagacttgaaaagggtgagaagattgataaattacttcataatggatatgcaagtatttcacttggatatgcaggtttatatgaatgtgtaaaatatatgactggtaaatcacatattgattcacaggaaggtcatgattttggtattaaagtaatgcagtttatgaatgataaatgtgaccagtggaataaagagcattatattggattttcaatttacggatctccaatcgaaaacacaacgtataaatttgcgaagtgtctacagaaacgctttggaattattaaaggtattacagatagaaactatatcacaaacagttatcatacatttgtaaaagaaccaattaatgcatttgataaacttgctaaagaatcagaatttcaggcgttatcacttggaggtgcgatatcttatgttgagacagatggattagtaaataatgtagatgctgttttggaaatgaataaattcatctacgaccatatcatgtatgcagaagaaaatacaaagtctgattactgtcaggtatgtggttatgatggagaaatcaaaattattgatgaaggtggcgaacttatttgggaatgcccaaattgccacaatagagataaagacaagatgaatgtagcaagaaggacttgcggatatattggaactaattactggggaaaaggacgtactcaggaaattaaggagagatatgtccatatgacagatattgcggaggatttataatgagatacgcacagattagatctatggatatttctaatggagagggagttggagtctccctcttcgtccaaggttgtccatttcactgtaaaaactgttttaattctgatacatgggattttaatagtggaaaagaatggacagaagaaataaaagataaatttatgaaattaattgatagaccatatattaaacgagtatcatttcttggtggagaatgtttagcggatcagaatttagatggggttttagatttaattaaagaaatccgtatttcttttcctgagaaaactatctggttatatacaggatatgaaatatcagagattgtaaaacaagaacagtacgaaagggttagtggaatacctgatgtttggtcaaaacgatgggaaatcattaaacaggtgaatgtgcttgtagacggagaatatatagacgagcaaaaagatctatcgttaaaattcagaggttcaaaaaaccaaagagtcatcaatgtgaaacaatctctcgctcagaacaaagtagttttatattgcgattaaggaagaatagtatggagagattaacaagaagagattggagtaaatatggattctacgacaaagagactccaatattaggagcaagacgtgaatatgaattatataaaaggcttgggcgttatgaggatatcggtacgctggaagaatgccgtgcggcggtggagaagcagacagcaaagaagccaacgcctattgactacgaaaaatatgcaaatttagtggataatgcaatatatcttagaggtgcatattggtgtccacgttgcaaacattttgtaaaaagtggtactttctgcaataaatgcggtcaaaaattagattggagcgatgaagaatgagtgctgtatggttcataattttactccttgcatggggaacggaataaagattaacgatatgtcatatatgatgattgcaattttttatgtcggagattgcattttaatgcagaacaggagggcgaacgatgggaagattaattgatgaggatgaactgataaaaggcagagttgagaatgatccagttgtgattgcgacaaaatgcgcatcgactgcctacgatccagaaaagattattaaacagttaaaaattatttcagacaaattacactgcgaaagaacaacaaaagtcgtaaatgaagatttttatgaaggacttatatgcgcatatgatgatgcaattgatattataaatggaaagcaaacaagaataggataaaatcataaaatattcaaaaaaaataaattttaaggagaataaaaaaatggagaaaattaaaattaaatactttgataacgaaattgataaactatcatatattggtggagacaaatctaattggattgaccttcgttctgccgaaacaattcatctgaagaaaggtgagtttcatttggttaatttaggtgttggaatggaattgccagaaggttatgaagcacatattgtaccgagaagtagtacatataagaattttaaagtgattcagacaaaccatatgggtgttgttgaccatagttattgtggggataatgatgtttggatgatgcctgtaattgctatggaagatactacaatcaacaagaatgatagaatctgtcagttcagaattgagaaaattcagccagagatccagtttgtggaaacagagcatttaggcaatattgatcgtggcggtattggaagcacaggagtaaactaatatgaaagaaaaaatagaagttcctatttggcagaaactccttctaacgatagaggaaacatctgcatattcaaatattggcagagataaaattacagaaatgacaaattttgatacatgtgattttgtaatatacaaaggaacacacaaactaataaacagaaagaaatttgaagattatataaacaatataaaagtattgtaatcattgaatttataccctttatatgatataaaagaagtgtcatataaagggttttctgtcataaaaacagaaagcgagatgaagattatatgtcgaacagaaaagataacaaaggtagagtgcttaagaaaggagaaagccaaagaaaagatggcacatatatgtatagatggactgatataggaaagaaaagacagtgcatctatgctaaatcattaaatgatttaagaaaacaggaacaacaattactctcagagatatcaaatggtgtattaagaacagacataacattaaatcaacaaattgaattatatttgcaaacaaaagcaaatatatcaaaatcaacttattcaaattatacttattattataaccacagtatcaaaaacagctttcttggtagaatggagctaaaagaaattaagaaagctcacattattaaattttacaaagaatgtcatgacaacaatatggctaatagcactattgctattttacaaaaaattataagaccttcactacaattggcggttgactcagactgtataatgaaaaacccggcaaatggatgtctcaaagactacactgttgaaaaggaagtaaaatatgcaatgagctatgaagaagagaatgagtttttggcaagatttgatatttgtacagaagcaaagttttacaaacctctcgcatgtttaatgctttatagtggtataagaataagtgaagctcttggtttaacatgggatgatattaatatggaagaaaaaaccatcaatattaatcatcaaatgttgtgtagaaatcttaatggaaaacttgtgcaatattgcgaggacaatacaaaaacatcaaacggatcaagaattatccctatgaatgattttgcttacaaatctgttattgaacaaaaaaagaactggttatcatgtaaaaaagatccagattttaatttagatggatacagcaattttgtattcctctcattcagaacgggaagagtagttagacatgcagttataagacgattatttagaaagcttgttcgagaatataatggtaaaagagacattcaattacctacaattagtcctcatatattaagacacacatattgtacaagattagcagaggcaggaacagatttaaaaacaatgcagtatcttatgggacattctgatattaacacaactatggaagtgtataatcatgttgatcgaaatagacttgaaaaggaaacacaaaaaattaatgatttacaccaaatttacaccaaaacatcataaagatatagaaaaatataggatattgtagttataagatatgataatagcatacacaaataacgatgaaaaagtagtagaaacatgaattttccttgacttcaccactgtatcatgttattatcacaaacagagtgaacaaagcgttcatgaaggggtacaccaccgcgggtgtattctttcgtgaacgcttttttattacaccgtaaaattaaaaggagaaaaatcctcccctcgtccaaagggacttggattttactccgtaaaattaaaggaggatgtatggaaatcaacggaaagcacacaaagttgccggagggaacaacgatacttgattatttagagcagaatcactatgtgttagcgcagattgcagtcgagcacaactatgtaattttggacaaagaagattatgcaaaagttgttttgaaggatgacgacattttagagattgtcagtttcatgggcggcggttgttaaatgccggaaaaagagaaataaaaaaaccagagaaaagcagaaaaacagagaaaagtaaaaaaagagaaaagcagaaaagaggaaaaaaagatgagcgaaataacaaaagatacatggaaattaggagagcatgagttttcttccagatttatattgggttccggaaaatattccttagaactgatcgatgcagcagtgaaagaggcaaaggcggagatcgtgacgatggcgctgcgccgcgcaaatgagggtggtgtggctaatatcttagattacatcccccaaaatgtgacactgcttccaaatacatcaggggcgcgcaatgcggaggaggcagttcgtattgcaagattgtcaagacagatcagcggaagtgattttgtaaaaattgaggtcattcatgattcgaaatatctgcttccggacaattatgaaacagtaaaagcggtagaagtattagcaaaagaaggatttgtcgtgatgccgtatatgtacccggatctcaatgcggcgcgtgatatgcagaatgccggtgcagcatgtattatgccgcttgcagcaccgatcggttctaaccgaggtgtctgtacaaaagattttatccagatactgatcgatgagatcgacctgccgatcatcgtggatgccggtatcggaaagccgtcacaggcatgtgaagtcatggagatgggagctgctgcagtcatggcaaataccgcaatcgcgacggctggtgatatcccggcgatggcagctgctttccgtgaagcgatcgaagccggaagaaaggcatacctctcaggctgtggacgtgtcaaaatgggaggggcaagcgcatcctcgccgctgacaggatttctctctgaataattcagaagatcagagcgttaaatatgagagcagaacaaaaatcagttttaggaaattttggaatcggaaaatataatacatttttatgatctgatttgaatggaaattgagtataaaaaatttcgggttcagaataagcacaggggaaaaaatcatggaacacatcaatgaaagtatattaagcgaagaaataaaggaacatcagaaagaggcaaggatcgaccatatggtatatctgccaggcatggaggcattaaaatcggatatcacaaaacaggtggttgaagcaatggaggcatacgattacgacagctatacagcggaagatgtaagatgtgccttggcaaaaagaaaccgcacaccggaagattttgcggcgctgctgtcgccggcggcagaaccgtttatcgaagagatggcacagtgtgcaaaagtggaaaaagaaaatcattttggcaattcggtctgtttttttacgccgctctatatcgccaattattgtgaaaattattgtatctactgcgggtttaactgtcataaccgtatccgcagggcaaaattaaatgcagaggaaatcgaagcggaaatggcggagatcgcaaaatccggtctacaggagatcttgatcctgacaggcgaaagccggaaaatgtcagatgtggaatatataggagaagcgtgtaagatcgcgcggaaatattttaaagtaattggtcttgaagtttatccgatgaattcggaggaatatgcgtatttgcatgaatgcggcgcggattatgtaacagtttttcaggaaacatacaattcagacaaatatgagacacttcatctggcaggacataaacgtatttttccttatcgtatggaggcacaggaacgtgcgatccgcggcggtatgagaggcgttggttttgctgctttactgggacttgatgatttcagaaaagatgcatttgcaacaggaatgcatgcttatctgttacagagaaaatatccacatgcagagattgctttttcctgtccgaggcttcgcccgatcatcaacaatgataagatcaatccgatggatgtgcatgaaaaacaacttttgcaggttgtgacggcataccggttgtttatgccatatgcaagtattacggtttctaccagagagtgtgcaagggtgagagacagtctgatggagatcgcagcgacaaagatttctgcgggggtcagcaccggtatcggaagccatgcgaaaggacttgaggatcagggcgacgagcagtttgaaatttctgacggaaggacagtaaaacaggtgtatgatgcactgcttgaggaaggattgcagcctgttatgagtgattatatttatgtgtaaaaaagaaaatccgattccggggaaaataattgctgtcacaaaccggagcctttgtgagaggccgtttttagaacagatcaaaagagtctgtgaaacaaagccggcagctctgatcttaagggaaaaagatctgccggagacggaatatgaagagatggcaagacaggttttggcaatttgtgaagaatatggagtgatctgtattttacacagttatatagaaaccgcaaaacggttagagaggcagtatgttcatttgccgcttccactgttaagaacttgtatgcaaaagacagaaaatgaagaaaaacagataaaatttatgtctgggaacctgtcaatggatcagaagaataaaaataagctgatcttaggctgttcggttcattctgttgaggatgctattgaggcagaaaaactaggggcatcttacctgaccgcagggcatatatttgccacggactgtaagagaggactgccgccacgcggaatggaatttttaaagcaggtatgtgaaaccgtaaatattcctgtgtatgccatcggtggaattggactgaacgatggaaaaatagacagcgtgtgtgaatgtggtgcggcaggtgcgtgcatcatgtccgcttttatggcaatatgataaatataaaaaacgggcagttatttcaaaaaacgacagacaatgaaagctgtattgccgattgcatataaaaaaatataaaaatttcaatcaaatttctcctgtcgcattgcacctgtttcaagaatctgctatactaaatcggatagtaaagtggagggacgatatgtcacaggcagttgttataaaaagtaataaatacgggatacatcttgtattgagcaatgagatatcttttaaagcacttttggatgccatcgtcgagaaattcaaagagtcagagaagttctttaaaggggcaaaactggcgatctctttcgagggaagaaagctgacgcatgatgaggaaatggctatcattgatgcggtgacatcgaatacaagtatcgagatattgtgcattgtagatcatgatccggaccgtgaagcatacgtcaaacagcagatcgaagaatatcaggcatctgtacagcagccgtatgtggatggtgggactcagttttatcgcggaacgcttcgctctggccagacacttgagagtgaaacaggaatcgtagtggtaggtgatgtcaatccgggcgcagcagtcatggcaaacggcagtatcgttgtacttggagcggtaaagggaagcgtctatgcaggacttgggggagatgacagtgcatttattgttgcactcgatatggatccaatccagattcggattggaaatattttagcaaaaagtccggacaaaccttttagcagacgaagaatacgaaaaaaggtcaaagaaacgaccacgtctccgcagattgcgtacttaaaggacgggacaatctgtattgaaccgctgacaaaagaactattaagcgatatttaacagcaggaggaatattttaaaatgagtgaagttattgtaattacgtccgggaagggcggagttggtaagacgaccacaaccgcaaatgttggaacaggtctggcacagttaaacaaaaaagtagtgctgatcgatacagatatcggacttcgtaacctagatgttgtcatgggtcttgagaaccgtattgtatacaatcttgtagatgttgtagaaggaaactgccgtgtggaacaggcactgatcaaagacaaaaaatatccgaatttatgtcttttgccgtcagcacagaccagagataaatccgcggtatctccggagcagatgcaggcattgatcgaagatttaagacaggattttgactatattttattagactgcccggcaggaatcgagcagggatttaaaaatgcaattgcaggtgcagacagggcacttgttgtcacaaccccggaggtttctgcagtgcgtgatgctgaccgtatcattggactgcttcaggcaaatcagatccagaaagttgatcttatcgtaaaccgtctgcgtatggacatggttagacgcggtgatatgatgaatgtcgaagatgtgtgcgacattctggcaatcaatctgatcggtgcagtaccggatgatgaacatatcgtaatctctacgaaccagggggaaccactggttggaagtaattgccttgctggacaggcatatgagaatatctgccaccgtattctcggtgaggaagttgcatttcttgatctggatgcaaaacagggagtattttcaaaattaaaagatttatttaagaaaaattaggaggaacagtcatgggattgatggacttatttaagaagaaaagttccggtgatgttgcaaaagaccgtttaaaacttttgctggtgactgaccgcgcaagctgttccccggaaatgatggagcagattaaaaacgagatcatccaggtaatttcaaaacacatggatattgatatggaaggccttgacattcagatcacgcagacagagtcagagtcgaacaatggaacggtaccggcattgtttgttaatattccgatccgcgatatcagacatggaaattcataaaattttataaaagataaaaagactgttcaaagaagaaagtatatttcatttggacagtcttttttatagtactattgacatataatagtgaaaatgctaatatcatactaatttgatatgaattagatgataatagaaagaaaacaggatgcagcagccaataacagaaatacaaaagatggttaaaggagcggtattccggaatggagtatgtcatgaagtacaattttgatgaagctgtggagcggagaggaaccggatgtttaaaatacgattttgcgaaagaacgtgggaaaaaagaagatgtcttgccgttatgggttgccgatatggattttaagactgcgcctgcagtgaccgaaagactgcagaaagtagtggaacacggaatttatggatacagtgacagcaaagaagattattttgcagcagtatcgggatggtatcatgatcattttgactgggatgtaaaaccggagtggctggtaaaaacaccgggagttgtttttgcacttgcggccgctgtgcgtgcatatacggaaaaaggcgatacagttttgatccaacagccggtatattatccgtttcgtcaggtcattgagtcaaatgacagaaagttagtcagcagcgatctggtattaaaagatgaccattatgagatcgactttgaagattttgaggcgaaaataaaggaacatcagatccatttatttttactctgcagtccacataatccggtaggacgtgtctggaaagagtgggaattaagaaaaatcggagagatctgtttcaaatatcaggtgactgtcgtcagtgatgagattcacagcgattttgtatatccggggcataaacatcatgtctttgcatctgtttcaccggagtttgaacagatttccgtaatttgcacggcaccaagtaaaacctttaatcttgccggtcttcaggtgtcaaacatttttattgcggatgaaaaactgcgtcaaaaatttgtccgtgcggtggatcaggcaggatacagccaggtaaatctgatgggacttgtcggatgtcaggccgcttatgaagagggagaggaatggcttttacagttaaaagaatatctgtatcagaatctttcctttgtccgcgaatacctgagggaaaatcttccacagattaaactgattgagccggaaggaacctatttaatatggctggatttcggagaacttggactgggaagaaaagagttggaagcactgattgatcaggcaggactttggttagacgcgggagcaatttttgggaaaacgggtattggttttgagcgcattaacattgcatgtccgagaaaaacgttagaacaggcatttttgcaactgaaaaaagcagtggatgcgttagattaaaaactttgtaacagtatgatatctgttcagaatgatcaaaaaggcacgaagatggcactgcggtggagtatatcttattgaagaggaactccactgcagtcatagcaaatcctctgcagaaagctgttgataagtcgatatcgagttacatcgtaccgtggcctgaatcaaaaatatccgtgaaaagctttatgacaggtcaatatctaattccaccgggcagtggtcagatccgaaaacatccgtgtggatctttgcgccggtcagcttatcattcatccgtttggaagtgataaaatagtcaatacgccatccggcattcttttcccgtgccctaaaacggtaggaccaccaggaatagatctgttctgtatccgggtaaaaatagcggaaggtgtctgtgaagccggcatcgagaagctttgtcattttttctcgttcttcatccgaaaatccggcgttcttccggttggtttttggattctttaaatcgatctcctcatgtgcaacatttaagtccccacagagaatgacaggcttggatccatcgagtctttttaaataagcacgaaaatcatcttcccactgcatgcggtaaggcagtctggccagttcgttttgagaatttggcgtataacaggtaaccatgtaaaaatcagggtattctaaggtgatgacacgtccttctttgtcgtgttcttcgatgccgataccgtaagtcacattcagaggctctttttttgtgaaaatcgctgtgccggagtaaccttttttcttggcataattccagtaggaaaaataaccgggcagaggaaggtcgatctgtccctcctgcagcttggattcctgaatacagaaaatatctgcatcagtttcatgaaaaaaatcaagaaagcctttttggatacaggcacgcagtccgttgacattccaggaaatcagtttcatagtattctccattcttttaattaggatgttgggaatgcactatttggtctcaacatcttaatatgttggtgttaaaattttttgttaccgtcagataaaactggattgtttccgcaagatatcataacattatcatttcattgaaacaaggaaaacatgtgattctgcatgaaaagaaaataatacggtcgaaacagttttgatatagttaaacaataatatggtataatttatgtcaataagtaagtttatggagcgtgtatctatggcaccacaggtgctgttgaaaaacggaaatgtgagagaaaggcagcgggtaaggattgatgaaacgcatttttttacagaaaaaacagaataagacgatactggagctgttaagggagcagggagaatatttagatgcgccctgcagcgggaaaggtacctgtggaaaatgttgtattataatagaagaaacacgaaaaacagatccgccaaaacagcgggaaaaggaagtgtttacggagcgggaactggaagagggatggcgtctttcctgtatgacggttccgacggatgatctgtatgtatgcattccggaaatcagagaaaatcagatacaggtgcagatggaatttgtccggaacacaaaaatggagagcgatgtacaggcgacaacagttatctgtgaaaacaaaatagaggaccgtgcacaaatagggtctgacggggaaataaaaccggaaaatatggatacggaaaaatccgtctatggtatcgcaatcgatatcggaacaaccacactcgctgcagaactgatttccctcaccgatggaatatgcttaaaaactgcatcttctgttaatcatcaacgggcatacggcgcagatgtgatttcaaggatccgtgcagcagcgtccggagatgcagaaaagttgagagagagcattttaaaagatgtgaggaatctggcagagacactgcttgcggggcaggacgaaaatgtgctgaatgtcagcaaaatcgtgatcgccggaaatactacaatgattcaccttttactgggatattcctgtgtggggcttggcgctgcaccatttactcctgtgaaccttgcgccggaggatatgacgtggggagaattgaatggtgagtatgaggaaaccagagaaagtggagatgccagagaaagtggagatgccaaagaaagtggagttgccagagacggtagtgatgccagagaacacggatatgtcagagaatgcgggcataccggaatcaatcagaccacaaaagtacagatcatgccgggaatctcagcttttgttggaggagatattacggcgggcatgatgggatgtggtatgcggccggacaaatgcgagatgctgatcgacattggaacaaacggtgagatggttcttgctgcgggagatcatttccttgtctcatccgttgccgcgggaccggcattcgaaggtggaaacatatcctgcggtatgcccggtgtgccgggagctgtctgccgtgcagttttatttggtaaaaataatatggtgacaaagacgattggaaataaaccggccattgggttatgcggaaccggaatcattgatgtaatgtatgaactcgtgcggcaccatattgttgatactcaggggattttgggagaaccgtggtttgaaaaaggatttccggtcgtacccggaaaaatttattttacccaggaggatatcagacaggtgcagatggcaaaagcagctatctgtgcgggtttagaagtattactgcagaaatcaaatatttctcatgaacagataaaaaaagtatatgttgcaggcgggtttggcatgggacttgacatggaaaaagcacttggaatcggacttctgccaatcggacttcgcggaaaactcacgccggtcggcaacagtgccttagagggagccgcacgatgcctgacacactcaaaagaaagcagtgatatgcagccgcaagagattgcagccatatcccatgagatcaatcttgcagatacaccagagtttcaggaattatatttaaaacatatgcaattctgttgagtcagaaaattggggtatttattcaacaaaaataccccaattttttgatgtctcattttgaatgaccaaaaatcaaggtatattttatcaattatttacggtattttaattttcttcccttttatataataaatacaacaaaagcagttcggaaatattttttttaaaacaatacttaaacgttttcgaaaagctccggatgctggcgaaaaccaaaaaagaagggaaagggagaaatgaaagaaacgggcatttcaaaaaacaacaaaacagatggttccggtgttacaggcaagttatacattgtacttcggatcgcagttctgttcgcagtcttattcatgttcatacctggaatcaatccagcgaggatcagcggaatgatcggaagaaacttatcgctgtttacttccggtatttcatactcatcactggcatcagagtttggacgtgcattccgaaaaggatgggttatgaaatcaacattacggcttgactctgtatcagctctgattatctgcgttggtacagcagcagttgcagccggaggatgtttatcactcggtaatctgaaaatgaaaaaattaagtaacatcttcacagcagcaggaagtgcagtgatgctgtcaggacttggcggtatcgcacttgcatacagtcagatcagccagacagaaaaacctaagaaaatcgagccgatcttttcaaatggtttttatatgatcctgatcgttgcagtactgatcctgatcgtaacattgatcgcgatggcaaaacagcctaaggttgaagcgggtgctaaatatgagatggaaacaaagtaccgcctgttcctgatgttaatgccattcctggcactggctggtgtattctgttatctgccattatggggatggagatatgcattctttgattacaaagttggtgataccttaagcatggataactttgttggattcaaatggttcacacagttgtttaaaaatcctgcaacggtaagagatatcatccgtgttctgaaaaacacacttgcaatgagtggtcttggaattttgacaagctggcttccaatggcatttgcaattttcctctgcgagattaaaaacatgaagttccgccgcgtcgtacagacacttacaacagtaccgaacttcatcagctgggttcttgtatatgcaatcgcattttgtatcttttctacagacggatttgtcagcagtttgatggtaaatgccggaatctggaaagagggcgtgaatatgctgatgggcggcagccatgtatggctgcagatgttagcctggggcttatggaaaggtatcggctggagtgcaatcatttatattgcagcaatttccggtattgatcagcagctttatgaagcagcaaccgtcgacggtgcaggacgtttccagagaatgtggaatattaccgtgccgagcctgatcccgacattctgtgtattactgttaatgtcgattgcaaatatcttaagcaatggtatggatcagtatttagtatttgaaaactctaccaatacaagttctatcatggtacttgacctgtatgtatacaaacttggtatcggacagggacagattccattatcaacagtaatcggtatggtaaaatccgttgtcagtgtaacgttactgtttgctgcaaacggtatttcgaaactgattcgtggcgagagtattgtataaggaggcgtaagacatggcaaaaacagcacaggaaaaggctgatttaaaagccgaaaaactttatgaaaaaacacataaacgcaaatatcgcttaaaaccgggcgatatcgtatttaacattttaaattacctgttttttacattatttacaatagcatgtatatttccattttattacctgtttatcaatacgatcagcgataatgatctggtaatcaagggtttaatcaacttcataccgagaggaatccattttgataactatacagcgttattaaatgtaagtgatctttcaagtgcattgatcgtatcactgtcaagaacagtacttggtacggcacttatggtagcagcatccggatttatcggatatctggtaaccaaagatgaaatgtggggcagaaaattctggtacagatttcttgtgattaccatgtatttcaatgcgggtctgatcccatggttcttaaatatgcagatgttaggtctgaccaatacattctgggcatacatcatccctggtattgtggctccgtataacatcattctggtaaaaacatacatagagtcaattccagcggaactcgaagagagtgctcagatcgacggagcaagcttctttactgtattccgcaagatcatctggccgctcagtaaaccgatccttgcgacgattgcgattttcggtgcagttggtcactggaactcctttacggattccctgatcttaatgacatcagctccgaaattatatactttacagcacaggctttacatttacttaaatcaggcatccaacttaagtgcattaatggagtctggcggatctgtcagcgaggctgttttaaaatcagcaatgagtggaaaggttatcaaatatacgatttccatggtaacggtaatcccgattttaatcgtatatccattcatgcagcgttactttgaaaaaggtatcatgttaggtgccgtaaaaggttaaagaggtgttaaccgcgaggcgcggaatcaaaataacacaaaaacaagggagtaaaatcctctcctcgtcaaaggactcggattttgcttcgcaaaacaaggaggattatatgaaagcaaagaaaatcgtatcactgcttctggcagctgcaatgacagtttccgtggcagcctgtgggggcagcaatcagacaagtgcatcaaagaacaacagcaacaatgcagcgggggatgctgcaggtgaagatgcaacagagagcggagtatccgaaggaacttctgcagatgaggcggaagatcttgcagatatcattccggaagagacagttactctcgatgtattcgatcagttagcaaactattccggtgagcagatcggatggtttggtcagatcatgttagacaaattcaatgtaaaattaaatatcatcccggattctgacggtgtatatgagacacgtatggagtcaggaaaccttggagatctggttctctggggaaatgattctgatgagtatcagcaggcagtcagcaagggaatgctctttgactggaacgaggatgatatcttaagcgattacggtccatacatcaaacagaacatgccatatgcattagagaaaaatgcaaatctttccggcggtactgtttatggattcggatttgatgttgcaagggatgcgacagcacgtcaggatttcatgtatacctgggatttaagatgggatctttacaaagagttaggatatcctgagatcaagactttagacgatatggtagatgttttaggtcagatgaaagagatctgcccgaccgatgataacggaaaaacaacttatggtgtttccttattcaacgactgggacggaaaccttgtaatgttcgtaaaatcaacagcaactgcttattatggatatgatgaatttggttttggtctgtatgatccagaggagcaggtattccatccagcattagaggaaaatggaccttacctcacatgcttaaaattctataacaacctgtatcagaaaggactacttgatcctgactcccagacacagggatatgacggtatgcaggaagattaccagaacggtggagcattcttaaatgtgttcaacttcttaggttctactttctacaactcagattcacatgcacaggaaggcaaagcaatgtatccttgcccgccggaagacgcagctccgatctgctatggtcagaatatctacggtggaaaccgtatctggtctatcggtgctaagacagagtatccggaattgtgtatggctatcttaaactggttatctactccggaaggacgtatgacagctgagtatggtccaaaggatgtctgctggtactatgatgaaaatggaaaaacgcagtttacagatttaggacgtgcagctaagacagatatcagcacacagatgtctgatggttacagcggaacatttgatgatggttcctttaagatgaacaatacaacgtgggcgattgattccttaaatcctgattcaaacggtgagacattcaactatcgtaaatgggaaagttttgcaacagatgcaaattctgacattgagcaggattggagagataagaccggttttgcaacagcagatgagtacatgggatcaagaccttacaaactttctcttggtacaacatactctgagtctacaaaatctgatgagttaactgtattatggacacaggttgctgagtgcatcaagacaaattcatggaaagcaatctatgctaagacagatgctgaatacgaccagatcgttgcagacatgatctcccaggcaaaagactacggctatgacgagtgtatcgcattccaggagaatgaggcatcacttagaaaagcagctgagaacgaagtaaaagggaccatcaaataattgtatcacaaatgaatgacagaccagagcagaagatccggacattccgtccggatcgccccggtctgttttcatcatactggatatctggagtaaaatcctgtatgatgaaagcagatcagaggtatgaaataaaatgagagataagaaaagtgcatgggaagcactttgagattggaggaaaacaaatgaaattttttagcgttgacagtccattgtaccgttttttaagcagagtacttgatattttaaaactaaattttttatggattcttggaagcctgccggtttttacgatcggggcatcgaccacggcggcaatgtcagttgcgttaaagttagcggatgatgaggagggctatatcgcgaaatcatattttgaagcgtacaaggcaaactttaaacagggcgttccgatgggactgatctttctggttgcatggtatgcggtatatcttgacttccagctgtttggagcagtgaaaaataatccggtcattttgctgatcatcggtatggtgtccgtatttcttgtgatcattgcgatgatctattccttttcactgctggcaagatatgaaaatacggtggtccgcacgatccagaattctatggatatttcaagaaaatattttggaaaaacactgatccttgtgatcctcgtcgcagcagaagttttgattttccagtataattcaactatgatattccttggaatcctgtttggaccaggatttatcatttatacgattgcagcaatgagtaagcgtgttttcttacagattgaacgcgtgaaccgcgagggcgagtgatagtgtcaatttaaggaggtttatatgatcgagagcagtaaagtacataaaattttatatggtggagattacaacccggagcagtggccggaggagatctggaaagaggacatgcgcctgtttaaattagcgcacattgatgtcgtgacgctcaatgttttcagctgggcagcactgcagccggatgaaattacctatgatttttccaaactggataagatcatggagtatgtgaaagaaaacggactgaaagtctgctttgcaacttcgacaggagcgcatccggcgtggatggcaagaaaatacccggatatcctgcgtgtcgggcataacggcatgaaacgcaaattcggagcacgtcacaattcctgtccgaacagcccgacttaccggaaatattctgtggcacttgccgcaaaactggcagagcgatacaaagattatgacaatatcgttgcatggcatatttccaatgaatatggcggggaatgttactgcgaaaactgtgaaaaagcattccgtgtatggctgcataaaaaatatggaacgctggatgagttaaaccgtgtatggaacacttctttctggggacataccttttatgactgggatgatgttgttttgccggatatgcgttcagaggagtttaactgggatggcatccgtaccaatttccaggggatttcactcgattaccgcagattcaattcggacagtatcttagactgctacaaattagagcgcgatgcggtaaaagagtacacgccggatattccggttaccacaaatctgatgggattttatccatcattagactaccagaaatgggcaaaagaaatggattttatttcctgggacagctatccttcctttggcgcagagacagaaaacaatgcgatggcacatgatctgatgcgtggattaaagggtggcaaaccgtttgcactgatggaacagacaccgagtgtgagcaactggcatacctactgtgccttaaagcgaccgggtgtgatgcgcttatacagctatcaggcggcagcgcacggcgcagatacgatcatgtttttccagatgagaagaagcattggtgcctgtgaaaaatatcacggcgcagtgatcgaccatgtcggcaatgagaatacgagagtgttccgtgagatcacagcacttggcgaagaactgactgaactttctgatacactgcttggtgcaagaactccgacagaagtggcagttgtatttgactgggataactggtgggcaacggtattatccgcaggcccaagccgttgtatcaattattatgaggagatttatcagtattataaggcactgttaaatcttcatatcccaatggattttgttggtgtggacgatgatctgtccggttataaagttgtcattgcaccgatgttatacatgtgcaaagacggttatgatgaaaagatccgcagctttgtcaaagcgggcggcacctttctgacctcctatttcagcggatatgtggaagaccatgaccttgtgatcacaggcggatatccgggcagactgcgcgatattttgggtatctgggtagaagaatccgatgcgattccggcaggagatgctggcatgaaacatacctttgcatacaaagatgtgacttatccggcagaagtgctttgcgatttatcacataccgaaggcgcagaaacactcgcaacctatgataatgacttctatgccggaatgcccgtactgacctgcaacacctttggatccggaaaagcctgctacgtcgcaacccgctccaatcaggacttctaccgcactttcttaactgacattatgaaagaagccggcgtagaacctctcgcagaaggcagtgacaaagtagagatcactctccgcgaaaataaaaacggcagcttcctcttcctcttaaatccgacggacgaatcacaggaagtaacgctgaaaaaagccggaactgacctgctcggcggaatgacttaccaggcaggagagaaagttgtacttccggcaaaagcagtggcgatcgttcaaagcaggtaaaggttatctcaggcaagtagagattttccacaaagaaaccgcgaaactcttcaaaaaactgaagtagttgagttccaggcacagcctaaattagagtttcgccccatctagagcaagaaaagaggacatacactatgtcggaacagcagaaagaacaacaacttctcgaaaccgtagaccgcatcatcgcagaaggcccgtaccagccagcctggtcatccctgatgcaggcgaaaacccctgactggtttaaacagaaaagatttggcatcttcatccactggggcgtctacagtgttcccgccaactccaacgaatggtacccaagaaacatgtacatcgagggaatgcccgcatacgaacaccatataaaaacctacggcagccagaaagactttggatataaagacttcatcccgatgttccacgccgaaaaatttgacccggcagaatgggtgcgtttattcaaagaagccggtgccggttatgtgtttccggttgcagaacaccatgatggatttcagatgtacaaaagtgaactgtcccactggaattcggcagaggtggggccgaaacgggacgtgcttggtgaactgaaagcggagattgagaaacagggacttacgttctgcacatcatcccaccgtgcagaacattggtttttcttaggacacggaaaagaatttgacagtgatatcaaagaaccattgcaaaaaggagatctgtactggccgtccatgccggaaccggatgcagaagatctctacggagagccgtatccgacagaagaatttttaaatgactggttagcacgcacagcggaaattatattaaattataaaccatccctgctgtattttgactggtgggtgcagcatcaggcgttcaaaccatatttaaagaaactcgctgcattttattacaactgcggcgtgaaatggggaaaagatgttaaaatctgttataaacatgatgcgatgatgtttggcagtggaattgtggaagtggagcgcggtgggtttgcggaagcaaagccctatgattggcagaccgatacggcagttgcaagaaattcctggtgctatactgacacattggattataaaagcagcaatgagatcatttgtacactcgtggatgtggtcagcaaaaatggtaatcttctgttaaatatcggtccgaaggcggatggaacgatcccggatggtgaccgtgctattttggaagatcttgcaaaatggatgagagtaaacagtgaggccgttatcggtgcaaatgtctggcgaaaatccatggaaggtccgacggcagcggcagaaggacagtttcaggatcagaaagaactgaaatttacaaacaaagattaccgttttacgattaatcatggaaatatttacgcaattgcgttacaatgtcctaaagatggtgttttctgtatccgttcactggcagacagcagtgatcagaatgtgccggagtttcatggtatcattgagtcggtggatattttaggatatgatggcaggctgcaatggtctgtggacggggaaggacttcatgtaaccgcacctggaatagacagtgagtttccggttgttgtgcgtgtgcgtccggaataaacaccgctctgagtgaaaaatgaacgaaaggcgtaaaaaacatgagtctgtttgcccggataaaaacattcataggcaatttaagactgcgggagagaatgctctttatatacattgccggaggaattctgccgattctgctgttggatatttatacttatcagaatacgagatcggtgttgatccagaaagcgaaggaaagcgagatggatgggttaaatatgatcgcggattcaatgagcgagagtatgtccgtcatctccgacatttccaaacagatgtactttgatgaaaagattgagcatatcgcatttcatcagtatgaaaactattcggagattcttgcagattacagagactatgataccatttctgattatctgaaatattattatcatgaaatttcaagtatcacgttgtatctgaataatgatacaatttccaataatgaatattttgtacatgtagatcaggagattgcagagaagccatggtatcagaatacgctcgaactgaatggaaaaccgtactggtcttattcgtatgattcgttaaaacgcaaggattcactccggatgtcgagacttttatatacgaaggatatgcagccggtcggtgtacttgcaattaacatgcagtataagaggacggagctgcctgtgcaggaacggacgcaggatacttatttagtgtataatgacacggtggttctgcaccgcaatgaatatgaacgggacacggatgaaatgattctgctgttaaagcagatcaaagatgatacttattccggcaaagtgcgttttcagggggaagatacctgtctgttatcgacggtgcgggtaaaaccggactattcggatgattattataccttagtcagtgtatgtccgtatgaagagatcgcaggatcggcagcccgcagtgcgttgggaagtcttgtgccacagcttgtctgtgtggtgtctggtcttggaattattctggtattttccaatcagttcagtacgagggtaaatacattccgtctgcagatgcataaggctgcaactggtgattttgatatcacggaggatatcggcggggaggatgagatctcggatctctaccgggatctgaaggtaatgatcgattccatacaggaactgatgaataacgtgatcaaagaacgtgtgcagaaagaacaggtcaatgcaaggcagaaagaagtggaatttaaaatgcttgcaagccagatcaatccacattttctgtataacacgttagagacgatccgtatgcaggcaagaattcataatcagccggatatcgaggaactggcaaagatgcttgcaaagatcatgcggagaaatatccaggtaagtaataccttgcagccgttaaaatcagaactgaaactggttgagtattacctgaaaatacaggattaccgtttccatgacagaatccattaccgtattgaaacggagggggacattgagccgttaaaggtcatgccgcttttgatccagccttttgtggagaatgcttttgtgcatggacttgaagcaaaggagagcggcggtgagatcgtgatccgggttgaagtgagatcacatctctggatcaccgtgacggataatggatgcggaatgtccatggaaaaattagatgaagtacggagaggtttgaacgattttgaaaatctggaccggacacatattggaatctgcaatgtcaatcagagaatcaagctccagtatggggaggattatggagtggaatttgagagtaagacaggagcgggaacaaaagtatgtattaaacttccggtgctgacatcggaaatcatgtgataaaaaatgaacacaaatgagttcatattagaagatttggatataaaataatgaggaaataatttaaaggggcaggatacatatgggaaggagttttttttacaggtatgcatgtagtttacttgcgtacaattcgcatgcaggcaggcggattgcatgtggtattatgacaggaagtctgttgatgggtttatatggctgcagtgctgcggaaaatacggtggctgtggatacacagcagcaggaaaccacacaggaatcattagaaccggtcacatttacattttacagtgcggatggattggaggatacctggacggatccggttgcgcagatgattacagaaaagacaggggtcacattgaaaatggattatcctgcagacagtaatgacaacaggatagaacttatggtggcaaccggggaatacccggatttcgtgtttgccaagggttcggtatcaacgctgatccgcaacaatgcattgatcgatatgtcggatctgatagatgagtatggtccgaatattaaaaagctgtatggagatgaatatgaaaatctgcgttattccagtgaggatccgtccatttatcagctgtgcagtgacaaagtgcaggaagaaaccttagaaacatccggaactgcccagctgcagtgggcagtattgcaggaaaaccagtatcgtgtaccatatacgttggaagaatacacgcagatgatccgtgattatatggaaaagtatccaatgatcaacggaaagccggccattggtatttcgatcgtctgttccgactggcactggtataccatgttatcgaacccatccgggtatatgaatggttccgcagacaacgggcagtggatcgtggatgatgaaaaacaggaagtttattataaacatgcagcggacgggcagaaagaatattataaatggctgaatgaaatgtacaatgagggcattttagatcctgaatttgcgacgcagacgcatgaggattttgttttaaaagttgcagagggaagagtgcttggacttttggatgaggaatgggattatacaggcgctgagatatccctgcgggcagatggacaggaggagcacacctatgcggggcttccggtcacaattgatcgatccgtgaaatgcccttctttaaaacagcagaatcttgcggtaggctgggggattggtattacaaaaagctgtaaagatccggttcgggctgtcaggtttttggactggctctgcagtgatgaggcacagatcctgttaaactgggggattgagggtgtcgattattattatgatgaaaacggaaaacggtgcattacggaggaggatcttgaagcgtcccggaaagacaccaattattctgagcgcacaggtgtgggatttcgtgtttatccatatccaagttatggaaatcagtcggttgattccacgggcaattcctatagtaagagctcaagggaaatggtaaaagaaggctatgatgagatggaaaaagaagcactgaaagcatggaatgttgacatgctgaccgatattttcccacagaaagaagaattttcaaaagatgcatattccccattgtgggcgatgacactgccagatgaactggaaaaaatgttagttgcgttagataatgtatcgtggaagggactcattgagtgtgttgtcagtccagccgatgattttgatgcgaaatgggatgaattacagcagaatttaaaggatgccggattagaaaaagcagaccgggaaatgaccgcattgctgcgggatgagatcagccgcagagagtaagagcataggaaagagaaataagtttatggcaaaaaaaatcatgattcagggaacaatgtcaaatgcagggaaaagcctgatcgtggcaggtctgtgccgcatttttaaacaggatggctaccgtgtggcaccgtttaaatcacaaaatatggcactgaattcttatattaccggggaaggacttgagatggggcgcgcacaggtcatgcaggcagaagcggcaggtatcagaccgcaggtctgtatgaatccgatccttttaaagccgaccaacgataccggttctcaggtcattgtaaacggtgaagtgcttgaaaatatgaaagcgagggattattttgcgtataaaaagaaactgatcccggatattttaaaggcttatcatacattagaacaacaggcggatatcatcgtgatcgagggcgccgggagtccggcagagatcaacctcaaagaaaatgatattgtcaatatgggacttgcggaacttttagatgcgccggtactgcttgttggtgatatcgaccgcggtggtgtgtttgcacagctgatcggcacgttagtcttactggaagaaaaagaacgggagcgcatcaaagggcttatcatcaataagtttcgcggcgatgtatcaatcttagacccgggcataaagatgttagaagaaaaaggtaggattccggttaccggggtcgtgccttatatgcatttagtccttgaggatgaggacagcctgtcagaccggtttgcagaacacgaggagaaagcggtggatattgcggtcatacgtttcccacgcatttccaattttacggattttatggtatttgaatcgatcgagggcgtttctgtccgctatgtggacacgctggaaaaactgcatcacccggatatgatcatcctgcccggcagtaaaaatacgatgggcgacttaaaatggatgcgccagaacgggctggaggctgccatcaaaaagcatgcgcaaaatcgggatgccgtgatctttggcatctgcggcggatatcagatgttgggagagtgcatcacagatccttatggtgtcgaggagggcggtatgctgcgcggtatggaacttttgccgatggagacagagatggaacaggaaaagacgagaacgcaggtggacgggacatttgaagaactgaccggagtgctgtctgtgctgtcgggtgtgaagctgacggggtatgagattcatatgggagcgagccgcaggacggatcatgccgagattgatatggatacggttatgatggatttaggtcggagtgagaagcccgaaatgcttcaggaaaaaagatatgaatatctgtgccatatcacagatcaggctgaaaatcaaaaagcagatggaatctgtgcaggtaatgtttatggtacttatgttcatggagtatttgatgcagatggcattgctgcaaagatcgttgaggcacttgccacaaagaaaggaatttccatggaggcagtgactcagcagaattatcaggaatttaaagagacacagtatgataaattggcgaagacgctgcgggagtatctggatatggatgcggtgtataggatgatggggatgtaaggctgcttgttaccgcacaacaggcgagaacagcagcgactggacggaccgatttgacggagtaaatttgtttattgctgaacacaggaaactgccctataataaatgataacggaaataaaaaagaagtacgcaggaggcagcgggatgggaagatacctgaagcagggaaatgaaagctttgaaaagagtgtaaattctgaaatttatatcgataaaataggtttgattaagtataccaaccgtgttctgaatacgctgcaggggtatgtctgtatcagaagaccggatgagaaaatccgaaaaaaggtacaggaaaactgggattccttagcgaaaccattagatggtctgggaatctttgaaaagatatttacacagatcggtgcagtgacaggggacgagagggtgccgttacaaaagaaggcagtgatcgtgatgtgtgcggataacgggatcgttgaggagggcatcagccagtccgggcaggaagtcacatatcaggttgcagaatccatgggaaaacgaaaaagctctgtctgccttatggctgcacaggcgaatgctaaagtcattccaatcgacgtcgggatcgcagcggaagaaacaccggaaggcgtctggaataaaaaggtgagcaggggtacaaaaaactttttaaaacagccggcgatgacggaggaggaagcattggctgcgatcgaagctggcatcgacagtgtaaaaaagtgcaaagaggatggtatgacactgcttgcaaccggggagatgggaattggaaacacgacgacaagcagcgcagtggcggcggcattgttaaactgtgagacggcagcgattaccggaaaaggtgcaggactcagtgacgcgggattattacataagattgcggtgatcgatgaggcgcggaaaaaatatcagtttgactccaaagatgtatttcgtattctgtgttcggtcggcggactggatattgcaggactgtgcggtgtctgcatcgggggcgcagtttacggtgtcccggttgtgctggacggtgtgatcagtgcagttgcagcacttgtggcagaacgtcttgttccgggcgtaaaggattttctgatcgcttcccacaaaagcagggaaccggcagcggcactgatcttacaggaacttggtgtacatccggtcattgatggcagtctggcgctcggtgagggaaccggtgccgttctgatgtttggactgctcgatacggtacatgcagtctatggtaaccggacaacattttcagatatcagggtggaagcatacaagaggtttacagacgtatgatggttgtagtgacaggcgcaagcggcagtggtaagtcggaatatgcagaaggtgtggcggtaaagctggcgggaaaaggagacttatattatcttgcgacgatgcgtgtctatggagaagagggcgtacgccgtgtggaacggcacagaaaacttcgcgccgggaaaggatttcaaacggctgagtgtcctgtcaaggtggatgaagcgtttgcacaggtatgcatgtcagagtctttggaacagacatgtgacacatcacatggaagagtatgtacgtcagaatttttagaacagggatgtgccaggctgcatggaaaaatacggatgcccgtggctttattggagtgcatgtcaaaccttgtggcgaatgagatgttcccggagactgtcggtgatgagataaatgcaaactgtgtagaaaatatcgtccgccagatcaggcacttgaaagaccagaccggacatctggtgatcgtgacaaaccagatctttgaggacggaattatctatgaaccggaaacgatggaatatattagaaatctgggtcagatcaaccaacagttagcagaaatggcggattcggtgattgaggttgtggcaggaatcccgatttttataaagggggagaaattatgatgacaacattaagagcactggtcattgcattttccatgtattcacagataccgatgccgcagtttacctggcaggataaagaaatgaagtatgcattctgctttttcccgtgggttggagcggccatcggcggtatcacgatgttctggtggtggttctgcggaaaattttcggttggaaatgtggcatttgccatgattggcacagccattccacttgcagttaccggaggatttcatgtggatggatttatggatacgatggatgcgttccattcttaccagccgagagagaaaaaacttgagatattgaaggactcgcatataggtgctttttctgtaatctgtctggtgctgtatgaactgatttatatcggagcatattcagagatagatgcagtacggcaggcggggatcgtggcagccggatttttcttatcacgctgtctttccggtattgctgcgatgacttttccgggtgcaaagaaagaaggacttttgtatatgttcacgagcaaagcgcatgagcgggccgtaaagaccgcactgtttttgcagacagcagcggtggcagtgctgatgctgtatttagacggagtgacgggagtggcagtgttagtgggcgcaggtcttacttttctgtattattataagaaatgtaaaaaggaacttggaggtattaccggggataccgaaggatattttgtgacggtgtgtgagtgtgtgatcgttgtggcagccgcggtatgtggaattgtacgatgataaaggaataacaaaaaagagggtgtaaaatgagactggttttaggtggagtggcacagggaaaacgcaattatgtaaaaacagcgtatcatatatcagagaacgacattttttcgggcgaaaacgcagaacttgagcagttatgcggcgcaaaagcagtagataagttccatctgtgggtaagaagaaaagtgaaagagcaggcagatgtgccaaaactcacagaaacatttataaagaaaaacccggattgtatcgtgatctgcaatgaagtcggatgcggtgtggtgccgatgttaaaagaagaaagagagtaccgggagcaggtcggaaggatgcaggtcattctggcaaaatcttcggagagtgtggagcgtgtgatatgcgggatagcacagaaaataaaataacaatggcatttatccggcatggagagacagcgtcgaaccgcagaaaaagttatcttggctggacagatgaaccgctttctgaggacggatgtgaaatgctgttgcgcaacaggaaaaattatcctgcagcagaccttatttttacgagtcccatgctaaggtgcagacagacaaaagagattttatataaagatcagccttatcagatcatagaaaaatggaaagaaatgaactttggcagttttgagggaaagacttactttgatttaaatggaaatgaagattatcagagatggatcgacagtggcggcacactgccgtttccggacggagagagccgggcagaatttatcacaaggtgtaaagcgggattgttggattgcctgatggaattagaaaaacaggtaactgtacaggaaaaggttgtctgcattgtacatggcggaacgattatggcactttttgacagttatggacagggttcctattttgactatcagtgcaggtgcggacagggatatgaatgtacgctgtcctatgcagtagacgcaaatggggtgatgaaagagacatcaatttccatgcgtgatgaaaaaataatttttggagagtaaagacatgtattatcatatgatagcatttctggcgggatttctgctggatctactgatcggggatccgcactggctgtatcatccggtgcgcctgatcggaaatctgatcgcagcgttggatcatagactgcttgatgtgacaggcataagaaatgaaaaaaaagaacggcgcgcaggtattttgctagtgaccgttgtactgcttgcgactggagcggtgagcggtcttttgctgtggggagcttatgcgattgcgccgatggcaggctgtattttagaaagtatcatgacatatcagatccttgcgacgaaatgcctgaaagttgagagcatgaaagtgtatgaacgtctgcgggcagatgatcttgcgggcgcaagaaatgcagtggcaatgatcgtcggacgcgatacgcaaaatctggatgcggcaggggtcgcgaaagcggctgtggagacagtagcagaaaatacgtcggacggtgtgattgctccgatgatctgtttggcgatcggaggtccggtgttagggtttttatataaggcagtcaacacgatggactcgatggtgggctacaagaatgaacgttacctgaattttggaaggacggcagcaaaactcgatgatgtggtgaattatatcccggcgcggatcagtgcggcgctgatgattgcagccgcctatgggccgggaaaacagttttccgggaaagatgccctgcgcatttttaagcgtgaccgttacaatcatgcaagtccgaactctgcccagaccgaggcagcctgtgcaggtgccctgcatcttcgcctggcgggggatgcaagctattttggaaaaatcgtaaaaaagccatttatcggggatgatttaagaccggtggaagcggaggatatcgtgcgggtaaatgtgcttttgtaccggagtgcggtgatcggagaaatcctgtgtctgctggcacttttggtggtaacattattctgacagtgaggatgccattcaaaatgaaaaaatggtttatatgattaaatgaaagaaagagagtctatatcaatgtttcgtaaaatgagaagatttaaacaggaattgagcaaggaagaatgtatggagattttgaaaaatgaaccgagaggcgtgctttctgtattaggtgacgatggttatccgtatggtatgcctgtcactcattggtacaatgaaaaaaacgggaaaatttattttcacggtgcaaaatcgggacataaaatagatgcgataaaaaattgtgacaaggtttctttctgcgtctatgataaaggctatcggaaagaaaatgactgggcgctgaatataaagagcgttattgtgttcggacgtgtccgctttgtagaagatcaggacacaataaatcagatatgcacgaatatgtgtgataaatttactgacgataaggaatatgtgaaagtggaactttcaaaatgcgggtcgagtgtgttatgtctggaattaaatccggaacatataacggggaaactggtaaatgagtcatagaatacggtaaattgaaaactacttgttctttttgttataaattgatataatgacgaaagacagcatgtcatagggaaatggaattatttatccggatgacattatagcagaaagaggagaggaattaaggtatgagtgaacctgaaaattatgtaaaaaaagaggagccgcgcgtatccataaaacagcgcaggaaaaaaagtataggaggcacactgggaacactgtttgcggagaatcagagtatgctgatgctgtttgcagctattgttgcagcacttgcggtgattctgacaggaatcattgcactgcatatgccggtcgttccagtctgcctgatcgtattattagagactggaattgcctgctgcctgcatgatgtgccgatctggctgcatgcgatcgctgtgatcgttcagatcatagccggggttctcaccggagccactgtttttatggtgctgtgtgtggtagaatatttggtcgggattttatgcctgcgttatgtgagagattaagggatgagtatggaaacggacttttgctatggggagatttttagcaggagtccgtttgtatttacaggaggaaaaagatgaatttaaatcagttattttgtgaaatgatacagtattacaggaacgatcccaaaagaatccagcattttacaaaggtacacagctatgcaaagctgatcggggaactttccggcatgcggggggaagaactgctgacactcgaggcggctgcctatgtacatgatatcgggatcaaagtggcggaggaaaagtatggaagcagtaacggcaggcttcaggagcaggaagggccggcagtggcagaggagatgcttggcagactgcattttgacgaaaaaatcatccggagggtgtcctatctggtcggacatcaccacacttatgaccagattgacggtctggattaccagatactggtggaggcagattttctggtcaatctctatgaggatggcgtgacaaaagaggctgtgatgcatgcatacaacaaaattttccgcacggaacatggaaaacgcatctgtgcagaaatgtttggaatcgaggaatgaccgatggaatcgcaggaaaagattttagtattctgttccagagagatctgctatttgtccggaaatttttttgcacatcagcttgcggcggcatttgatgatctgggatatgagactactgtttgtgaatttacatcccaggatgatcttgatgccgtgctttctccgttttttgggaaaaaatatcgtgcagtatttgattttaattccttgctgccacggcttgcgatggatgacggaacaccggtgatcgacctgatcgacgggccgttttatgattatatcgtggatcatccgttgtttcattataattgtctgatgacgcgggcaaaaaactttcatgcgatcgttcttgacgaggggcaggcagattatgtgaaaaaatatcatccgcaggtaaagagcgtacatatgcttccgcttggcgcaaccatcgctttatttgacggcgaaaaaaatcccgcagaccatatcctttttatggggacttatgatgcgccggaaaaagtatatgatatcgtaaaggcggcaccggagccattttgcgggatgatgaagcggatcatagaaatgcggattgcggtgccggaacttccaatggaagaagcatttgcggcatgtttaaaagaagatgacatggagcttgacgaagcgcagtttgcactttttatgaatacgatgtatgcgtcggatgcttatatcagggattatttccggaaagcggcactcgatgaactcttgaaaaagaaaataccggttcagttagtcggcgagggatgggaaaaataccagacaccgtatgagagataccggacgatcgagaagccggtcacctttgatctttcctttgaaaagattgcgagagaacagatcatgcttgatgtttcgccgatctttaaccggggcgtccatgaccgggcaatcgcagggatggcgaaccgtaccgtggtgctgacagattcgaatccgtaccggtgtgcgcattttaaaaaccgcaaggatatgatgttttattcgctggcaaaaatagattcgctttccgaggctgccggggaactgatggaaaatgaaaaactccgttcagaaatccgggaaaatgcatatcagaccttttgtgccggacatacctggagggcgcgtgcaaaagaaatattgtcatgggaggcagaagattgaagcagaattatcagaaaatgttagaggaaaccattgcaaaaaatcagcgcgaagagcgagtgccttccctgctgctgcatagctgctgtgcgccgtgcagctcttattgtctggagtatctgtcccagtattttaaaattacggttttttattataatccgaatatttatccggaggaagaatatacaaagcgtgtggcggaacagcagcattttattgagcggcttccggcaaaatatccgatttcttttgtggagggaacctatgacaaagagtgcttttatgagatggcgcgcggtttagaggatgtgaaagagggcggggaacgctgcttccgctgttatgagctgcgccttagggaatcggcagagcttgcaaaggaacttcacatggattattttacgacgacattatctatcagcccgctcaaaaatgcggaaaaattaaatgagatcggggaccgtctgtcggaagaatacgggatcgcatatttgaattctgattttaaaaagaagaatggctataagcgttccgtggaactatcggaggagtatggcatgtaccgccagtattactgtggctgtgttttctcaaagcgggagcgggatgcacagatcgcggcaaaagcggcagctgggaatgcataaattcctgtataaaaatacaacagggacttgcggcgaaaagacacttcatgtagaatggaagataatttatgtaaggaaagtgaggatttagatatggcacagttatggggaggacgctttacaaaggcaacagatcagcttgtatataatttcaatgcgtctatcacatttgaccagaagttttataaacaggacattgagggcagcattgcacatgtcaaaatgcttggaaaacagggcattttaacggagcaggagatgaacgacatcatcacgacactgcaggagatcaaggaggatgtggagagcggaaaattagagatcacatcggaatatgaggatattcacagttttgtggaggcaaatctgatcgaccgtcttggagatactggtaaaaaactgcataccggacgcagccgtaacgaccaggtagcactcgatatgcgtctttataccagggacgaggtgctcgcggtggacggactgctaaaagaacttctgactacaatcttacatattatggaagaaaatacagagacgatcatgcctggttttacccatctgcagaaagcacagccgatcacattggcacatcatatgggtgcttactttgagatgtttaagcgtgaccgtctgcgtctgcatgatatttatgagcgcatgaattactgtccgctcggttctggtgcacttgctggcacgacctatccgttggatcgtgaatatactgcagagctgctcggtttttacggaccgaccttaaacagtatggacggcgtgtcggaccgtgattatctgatcgagttcttatctgcatgtgcgacgatcatgatgcacctttcccgtttttccgaggaagtcattatctggaactccaatgaataccagtttgtggaaatcgatgatgcatacagcacaggaagcagtatcatgccgcagaagaaaaacccggatatcgcagagttagtgcgcggtaaaacaggacgtgtctacggtgcattgatgtcactgctcacaaccatgaagggaatcccgcttgcatacaataaagatatgcaggaggacaaagagctttcttttgatgcaatggatacggtaaaaggctgtgtcgctttgttcaacggcatgcttgccaccatgcgctttaacaaagacagaatgcgccagtccgcaaatcatggatttacgaatgccacagatgcggctgattacctggtaaaccacggtgttccattccgtgatgcacatggaatcgtcggacgtatcgtgctttactgcctcgataaaaagatcccgatcgatgatatgagtttagaggaattaaaagcgatcagtccggtattcgaggaggatatttatgatgcgatctctatggaaacatgcgtcaataaacgtctgacagtcggtgctccgggcaaagaggcaatggagaaagtcattgaaaaagagcgtgaatatctgagtaaggaatggatgtaatacttttacacactgacgtgatattgtgacaaatgcacaagttttcgccaaaaatacaggaaactttgacaaaataagcattgctttttttcgggaaatagcataatatatttactatgaaagacacatgtttgcgacagacggacaaacagagaataagggacgaggagattagagcaaaatgagcgaaaagttaaaagttggtattcttggcggaacaggtatggtaggacagagatttatctctcttttagagaatcacccatggtttgaggtgacaaccattgcagcaagtcctagaagtgccggaaagacctatgagcaggcggttggtgaccgttggaaaatggatactccaatgccggaggcagtgaaaaacatcgttgtcatgaatgtcaatgaggtagagaaagtagcagcagaagtcgatttcgtattctccgcagtagatatgaccaaagaagagatcaaaaagatcgaggaagattatgctaagacagagacacctgttgtttccaataacagcgcacaccgctggacaccggatgttcctatggtagtgccggaagtaaacccggaacatatggaagttatcaaataccagaaagagcgtcttggcaccaaacgcggtttcgttgccgtaaaaccaaactgctccatccagagctatgcaccggtacttactgcatggaaagagtttgaaccgtatgaagtagttgccacaacctatcaggcaatttccggagctggtaagacatttaaagactggcctgagatggtaggaaacatcattccttatatcggtggagaggaagaaaaatctgagaaagagccgcttcgtatctggggtcatgtggatgcagagaaaaaagcgatcgttcctgcagaatcaccggtgatcacctgccagtgtatccgtgttccggtattaaacggacatacagcagcagtatttgtaaaattaaagaaaaacccgacaaaagagcagctgatcgaggcattgaaaaacttcagcggtgttccgcaggagttaggacttccaagtgcaccaaagcagttcatccagtacttagaggaagacaacagaccacaggtttccttagatgttaactatgagaatggaatgggtatctctgtcggcagattaagagaggataccgtatacgactggaagtttgtcggactttcccataacacagtccgtggtgcagcaggcggtgcagtactttgcgcagagctgttgaaagcacagggatatatcacaaagaaattataaaaataggaaataacaaaaagcgccatcggatcaggacgtccggtggcgttttatattgcctaaaaagttaaaaaatgatataatttctcctatgtgaaatacaaacgggagggcggaaacatggttgtaaaaacggctgttttaaaggaattagaaacactgtatgcaaagtccggcaatcagttatgcgttttatatggcaggccggatctggaaaaagaattgttattgaagactttcctgcagaacaaaaaagccttttattatcgtgcacggtatgcgtcaccggagtcacaaaaacagatgatggcggaagcgttagaggaaaaactgcaggtcaggctgcaaaaatatgattatgaggaatattttaaccggatcaaaagcggcggaccggaaaagcttatcttagtgatcgatgagttttcttatattgccaaaaaagatacggattttatcaatgctgttttaaagttaaaggcaaaaaaattgtatccggggccggtcatgatcctgctgtgcagctctgttgtatcgtgggttgagaaggaaatggaaaattgtatcggcacagatgcagtgaaaaagatcgatcagacgatcaagctttccaatctgaattttctggaagttgtgcgtgtacttccggattatccggtcagcgaatgtattcgggtttacggcgtgatcggcggggttaccggttatatcaatcactggaacccgaaggtagatttaaagaccaacatctgcaggcagattttatcaagaaacggctatatgtataataaggcagaaaatattatcggtgcaagcctgcgggaattgtccgtgtatgatacaatcttagcttgtattgcgggcgggtgtgacaaattaaacgacctgtacttaaagacaggattttcgcgtgcaaagatcagcgtctatatgaaaaatcttgccgcttccgacattatcgaaaaggcagtatcgtttgagaccggcggatgggagaatgccaaaaagggagtttaccggatccgggataactatgtcaatttctggttccgctttatttatccgcatttgtcagctctctacatgatgtctgcggaagagttttatgatacttacatcgaaccggggttaaatacctacttaaaccgttactttgtgggtgtctgcatggaatatctgtggcttttaaatcttacaggaaaattgccgcttcatattaaaaaaatgggaacatggatcggcaagacaggaaatattgatatcattgcccagaatgaagtgcgggaaaatctggtcggtttgtgcaactgggaaaaaccgcaggtcacaatggagatgtgtgaagaattgtttgcaaatatgaaaaaagcaaagatcagtgcgaattattatttcctgttttctgcgagcacatttgaacaggcagttgttgaaatggcagaacaggataagcgttttgttctgatcgatatgagtgaattataaaacagaaacggagaaatactttagtggcaaagtctttgataataacggagaaaccaagtgtagcgcaggaatttgcaaggattctcggcgtgagcggacgaaatgacggatatattgaaaatgacaaatatgtcattacatggtgtgtcggccatttggtggagatggtctatccggaagaatacgatgaaaaatacaaaagatggaggttggaagatttaccgtttctgccggaagaatataaatacaatgtaataccaaatgtcagcaaacagtatgatacggtgcatcggatgcttttcagagaggacatagaaactgtctactgggcaggcgatgccggaaaagaaggacagacgattgaggaaaatatcagacgctttggcggggtcagaccggggatgaaagagctccgcgtctggatcgattcacagacggaagaggagattctgcgcggaatccgtgaggcaaagccaatggcagagtatgataatctggcaaaatccggtattatgcgcacaattgaagattatgcaatgggaatcaatttctccagggcgatgtcggtaaagtacgggaagctattgaatgatgctgcggcgactaaaagttatacggcgatcgcggtgggacgagtcatgacctgtgtacttggaatggtcgtgatccgtgagcgggagatccgcaactttgcggagacgccgttttaccgtgtggtgggaggattcctgccggaaggcgcggaaacggaggagacagtaaccgcagagtggaaggcggtaaatggttctaaatattttgaatcgccccttttgtataaggaaaatggttttaaaaagcgcgaaagcgcggaaaatctgatcggtgaacttgacggaaaacaggcggtcgtaaaatccttagagcgcggcacatccagaaagaaagcaccgttattatttaaccttgcagagttacaggcagagtgttcgaaacgatataagatcagcccggatgagacgttacaggtggcacaggacttatatgagaaaaaactgacgacttatccgagaacggatgcgagagtgctctcgacggcagttgcaaaggagatcgggaagaacttaaatcgtttaaaaacctatgagccgacgaaaacttatacggagcgtattttaaaagagggtacttaccggaatattgcacgtacacagtatactgacgattcaaagatcacagatcactatgcgattattccgaccggacagctcacggaacttggttcgttaagcgatttacagagaagagtgtatgacctggtcgtgcgccgcttcttaagtatcttttatccggcggctgagtatgaaacgatcaaactggtggtacaggtgggggcagaacagctttttgcatctgcaaaggtgttaaaaaatccgggatttcttgaaatcatgggaagaccgggaaatgatgaaaataaggaagaagagagtgcgggacttttaaaactggcgggacagttaaagaccggcgatccgctgaatgtggatggttacgagatcaaagaggggaaaacggcaccgccaaaacgttacacgtccggttctatggtgcttgcaatggaaaatgccggacagcttattgaggaggaagagttaagagaacagatcaagggatcagggattggaacgtctgcgacaagagctgagatcatccgcaaactggtgcgtatcgggtatctgaatctgaacaaaaagacgcaggtgctaagcccggaagcgatcggagagatggtgtttgaggtggtgagcatgaccgtgccggcactcttaaatccgaagatgacggcttcctgggaaaagggactcgacggtatcacgcgtggaacagtcatcatggaagattatcgcagtaaactggaagattttatccgcaaagaaacggtttccatgatcgaacatgacctgaccggcaatcttgcgacgaggattcatccgtttgtcggaaaaggcggaagagggcttgccacaaagaaaaaaatagaggcagtctgcccggtctgcggcggggagatggagacgacaccgttcggctatggatgcagcaattataaaaaggacggaagcggctgtaaattttccatcggaaccattgcgggcagagatttagcggaagaggaagtggtcgaacttctgacgaaaggacatacggaagtgctctccggttttatctcaaagtccagaaaacgtttttcggtggcattagtacttgaaaaggatgaggaaggaaaagcatctgtcaattttgacttttccaaaaatgaacctgaaatattagaaggggtgaaatgtccggtctgcggttctgatatggaaatcacttcttttggttacagttgtgtgaaacaccgtgaagatccggaaagctgttatttctacattggaaaaatcgcgggaaaatcccttagtgtggatgacctgactgatctgctgcaaaaaggagagacggaggtcttaaaagggtttaccgcaaaaaataaaaagaagttttcggcggcattgcttttgaaaacaggagaggatggcagaaaaacagtcgaatttgatttttcaaagaatgaggcagagatattagaagatgtagtctgcccgatgtgcggcggacagatccagaaaacatcatttggttatggctgtatgaattacgaccagcaaaatccgcagagctgccgctttgccatcggtacacttgccggacgtgatctgacagagtcacaggtgaaatcacttttaaccgacggcagaacggagacgatccgcggttttaagtcaaagacgggcaaaaaatttgatgcctgcgtggcattagaaaccgatgaaaccggtcggaaatatttaaagtttgactttgatcatgcggaggcaaaaaagataaaagatgtttcctgtccgctctgcggcggtgacattgtgcagacaccgttcgggtatggctgtgcaaattataaaaaagatgatccggaaagctgccgtttttccattggaaagatgggagaaaaaacgttaaatgaggcacaggtaaaacagcttctgacagaggggcggacggcgacgatccgcggatttaagtcaaagacaggaaagaagtttgatgcaaggattgctttaaaaaaagacgaatccggcaaggtaatcggactaaaatacgatttctcggatgtggaagcccccaaattaaaagatgtgaaatgcccggtctgcagcggtgatatggtgaaaacgccgttcggctatggctgcgcaaattataaaaaagatgatccggaaagctgtcgtttttcggttggacagatcgcaggagtaaaattaaaagaagcacaggtcaaagaacttttaaccaatggaaagaccggtgtgatcgaaggatttatcgcaaagaccggaatgaaatttgatgctccgttaaaactgaccaaagaggggcagatcacctttgattttccggagaaaccaaaacctgtcgagacaacagtaaaatgtccgaggtgtggggaactcttaaagaaaagccaatggtactatgagtgtgactgcggttttaaggtagggcatacggttgcgaaagtgccgctttcggaagcaatcataaaagaactgttggaaaccggaaagacaaaggaaaaagtgactggatttaactcgaaagcagggaatgtgtttgattcctgcctaaaatatgaggatgagcggatcagttttgattttgacaatcctggaagcctgtctctgcaaaaacaggagtcagagaaacaatcagaagtgcagatggctgtgcaggaaaatgagactgaaaaacagcagccacagcaggcagaacagacaccggatggtgcggatgatttctatgccactatggcggatgaggctgcagcatttcaggaacaggaagaagcagaatggatcgctggaagtaattttttagatgaatttatgccataagaaatctccggcagacagtaattcttgtctgtccggaaatttttttgcagtgttcgaatattattttgacagatctgtgaaaacgttttacaatagaaccagtatgcaaacagaaatgccaggatcacactggattcatatccatgtgacagagacattctgggatggaggaaaagatggaaaacgcaaaaatcagcaatttatatgatttagatgaaacaatcgcaaaagaatatttagaacagtttacatatccatgggaggctttaaaagggatcagtgagttcataaaaaaacttggaccaacattagatccggaaaagtttgaaaaaagaggcgaggatatctgggttgcaaagagtgcaaaagtggcaccgacagcatgtttaaacggtccgctgatcattgatgaggatgcagaaatccgtcactgcgcatttgtccgcggcagtgcgatcgtaggaaagggttctgttgtcggcaattccacagaactgaaaaatgatattattttcaattccgttcaggtgccgcattataattatgttggcgattccattcttggctataaatcgcatatgggtgcaggttcgatcacgtcaaatgtgaaatccgacaagacactggttgtggtaaaagacggtgatgagaagatcgagactggattgaaaaaattcggtgccatgcttggggattttgtggagattggatgtaactctgtattaaatcctggaacggtgatcggcagacatacaaatgtatatccgctttcaagtgtcaggggagtgatcccggcaaactcaatttttaagaaaccgggcgagattgtacagaaaaaagaagcatgatattcttaaacttaagatccggacaggtcggataagttatggcagaaaatattgattatattttaagtacagggagataaaatatatggaagaagaaaagaaatatatttataatgataaagcggaacggatcaaaaagatgaaccggttctatataggtgcaaccatatttcttggaatattgtttttactgtatctgtggctccgcatggcaaatcagaatctggtaaatgcaacagtatatgggaatactgtattaataataggcgcatcagttttgaacacgattatttatcataaagatcatgcaacagcaaaattaaaagtgattgctacgcttgagatgggattagagtatctgttagtcggagtacagacagatgcacattttattacgtatgtactgatcgttttagttgcgttacagattccgtactatgataaaggtggattaaaaagaacctgtgtgggagtgagtattctctacgtgatcgttacgattgttcagggaataaagggtattactgtattgaacgtggatacaatatgttctgtggtcggcgtgcttggcgttttatttatggtttcaagaattggaaagatcacattattgtttaacgcagatgcacttggatccatagatgaggaacacaaaaagcagaatgaaattttacagggagtgcttgagatttccaaaactgttcaggaagaatcagttaagagcagcagcctgatcggaaaactggtcgagacgaccaattctgtaactggcagtatgcaggagattacaacggcttccggaatgaatgcaaacagcatcgaagaacagaataccatgactgcaacgatccaggatgcgatcgaggaaacaagtgagcgatcaaaacagatggtggatatcgcaatgaattcaaatgacagcattcaggaaaatatgcgtgtgatggatgagttgaaagatcaggcagagcagatcacaaatacaaatcatgatgttactgaggcaatgaccaaacttcaggataagacaaaagaagtagaagagattgcaggtatgatcttaaatatttcaagccagacaaacctgctggcgttaaatgcatctattgagagtgcacgtgccggagaagccggaagaggttttgcggttgtagcagagcagatcagacagcttgcggaacagacaaaaaattcgacggaagagatcacgagaattacaaacgaactgaatgcaaatgcaaatgatgtggttgtatcagtagaaggttctgtacaggcaacggaagatcagaaagaaaagattcttgctgcgtcagaaacatttaatctgcttaataaaaatataggtgagctggttgcccatattgaagaggtcaataaaaaggtaagcggactttcagattccaacaataagattgtggtaaactgctcgcagctttcggcagcgactgaggaagttacggcgagtgcagaacaggtacatacactcagtgaagaaaaccttgatgttgcaaaacaggttcagaatgcggtagagaaaattcacagtacggcagatgatataaaaaagtttttgcactgacagaaaggagtgcataattatatgaaaaataaagtgtggttgtttacagccgcacttttgctttttacagcagggtgtggtgagccagatatggcacaaaataaaataaacagcaatgagcagaaaacagcaggaatttcagatacagatgaaacagaatccgaaatagacagcagtgcgtctgaaaaaatggaagcaaccgaagaaaaatatatctggaaagagatcacgctgcagttcccggagagctgggaagataagtatgtaattttagaagatgataccggtttttctgtttttcagaaaaaatcctatgagaaagaaaaagggatgggatacctttttggcatttcgaaggacacggaatggtatccggatgctgccggtgtaagtattttaggatataccgatgatggagtgttatatgaggttgtgaggcctacggatgtgagctgcgatgtggaaaatgaggatactttaaatgaatatcaagggatgatgcagcagtcagatacggtagtacagaatgcggtcattgatacacagaacctgcacaaagatgctgaccagtatatcattccggtcagtatgacacagacaatttcggcagacagtcttatcaatatgtcggacaatgatttatggttagcacgcaatgaaatctatgcaagacatggacggggttttaccaatgaatatctgcagagttattttaatgcatgttcctggtatgaaaaaacggcggagacagatgcatttgacgagtctgtgttaagccagacagagaaagataatctgaaagtgatacaggaagcagaaaaaacatatgcagacgaacatccatatccgaaagagtataaaacaggacagaaagttatggaagatattgatggagacggcagggaagaagaaatacgttatgatgtgaaagagagtggcgattatgcagggtattcctgtatccttaccgtgaatggaacttcatatgaactgtgcgaatatgcggcgatggtgacaccggaaacagattgcttttatgtcactgatattaatgcttatgatgattcgttagagattgctgtcttagatgatggaccgagtggtgattatgtgacatatttttaccggtatgatggaaacacactcgaatttgccggagaagttactggttttccttttaaagaaaaaaatggcggtatcaacggctttaccggacaaagcggaatctatggaacaattcgtacagatattcttgagacagcatacttaaatggctactggtggtatgacagtgatgcggggaaactggaatatattgatggcggtatgcatcaatacaagtatttcacaccgcacagattatatgtggatcttccgttgtggaaagctatggatcagaattcggaacaggtaacggtttcgtccgggcaggatgtgttctttatcagctctgatgcaaaggaatggatctatgtgcgtgcaaaagacggaacagaagggtacatccatgtggatggtgaaaatgtcagcaacgtcggcagacccggcacggaagttttttcagaattgaattattttgattagtgtataaaaacaaatacacggaataaagataatttttttcgattaggacttgtagatttcaacaaaatgtgcgaaaataggtaaggtatgttaaatgtataacaaagtctgatacatacagttctattaagtgaaaggagtcttaaaatgatttacactaaggaagtcgaaaacatgtgtcctgtagcaaagggcgcaaaacatgaaccagctccaattccggaagaaggcaaatgggttcattctaaaaaaattgaagatatttcaggttttacacacggtgttggctggtgtgctcctcagcagggtgcctgcaagctttcattaaatgtaaaaaatggtgtaatcgaagaagctttagttgagacaatcggatgctctggtatgacacattccgcagctatggcagcagaggtattacagggcaaaactattcttgaagcattaaacacagaccttgtttgtgatgcaatcaatacagcaatgagagagttattcttacagatcgtttacggtcgtacacagagtgcattctctgatgacggtcttgcaatcggtgctggtcttgaggatttaggtaaaggacttcgttcccaggttggtacaatgtacgctaccaaagagaaaggtgttcgttacttggagatggcagaaggttatgtaaccggtattgctcttgacgagaataacgaagttatcggatatcagttcgtttctcttggaaaaatgactgacttcatcaaaaaaggcgatgatcctaacactgcatgggaaaaagcaaaaggacagtacggccgtgtggcagatgctgttaaaatcatcgacccgagagaagagtaggaaaggagacggacgaaaatggcattatttgaaggatatgaaagaagaattgaccagatcaacgctgtgttaaacagctatggtatcagctctatcgaagaagctgaaaaaattacaaaagatgctggacttgatgtttacgatcaggtaaagaaaatccagccaatctgtttcgagaacgcttgctgggcttacactgtaggtgctgcaatcgcaatcaaaaaaggatgtacaagagctgctgatgctgctgcagcaatcggtgagggacttcaggcattctgtattccgggttctgttgcagaccacagaaaagtaggtttaggacatggtaaccttggtaaaatgttattagaggaagagacagagtgcttctgcttcttagcaggacatgagtcattcgcagcagctgagggtgcaatcggtatcgctgagaaagcaaacaaagtacgtcagaaaccattacgtgttatcttaaacggacttggaaaagatgctgcacagattatctcccgtatcaacggattcacatttgttgagacacagtatgattacaaagctgcaaaattaaatgttgtatatgagaaagcatattccaacggacttcgcgcaactgtaaaatgctacggtgcagatgacgttcaggaaggtgttgcaatcatgcatcatgagaacgtaggtgtttccatcactggtaactctacaaacccaacacgtttccagcatccggttgcaggtacatacaaaaaagaatgtatcgagcagggtaagaaatatttctcagttgcttccggcggtggtacaggacgtacacttcacccggacaacatggcagcaggtcctgcttcctacggtatgacagataccatgggacgtatgcactctgatgcacagttcgcaggttcttcttccgtaccggctcacgttgagatgatgggtctgatcggaatgggtaacaaccctatggttggtgctacagttgctgttgcagtttctgtagaggaagctcataaggctggtaagttctaagataaatttaaagcatagaaagaaacgggatttttgtatttgcaagaatcccgtttctttttttgtataaatttatttgaaattcgaaatcagtaccttttggaggatattgcaaagtatggaaaacaaatatattagcagaagagtattttgaaaagggaatacaggaagaaaatatttttatttttcaaaaacagggtgataatcgaacatattttctgctataataatatctataccagaaaaacagaaagcgaggcatcatccggtcatgagtgattcatcccatatctatattgcaatcgatctcaaatctttttatgcatcagtagaatgtgtcgaacgggaatgcgatccgctgacgacaaatcttgtcgtcgcagatgagagcagaacagagaaaacaatctgtcttgcagtatcaccgtcactgaaagcatatggaattccggggcgtgcgaggttatttgaggtcgtgcagaaagtaaagcagattaataaagaacggagaagcaggatcgccggaggtgtgtttaccggaaaatcagcaaatgcggaagaactgaaaaaagatccgacactggaactgacctatattgcagcgccgccgcgcatggctctttatatggagaaaagtaaccaaatctatgacatctatttaaaatatgtggcaccggaagatatgcatgtgtattcggtggatgaagtatttatggatgtaacacattatctgaaaacatatcagatgagtgcgagagaactggcagagaaaatgatccgggatgttttaaaagaaacaggggttacagcaaccgccggcatcggcacgaatctgtacctgtgtaaggttgcaatggatatcgttgccaaacatgtaacgccggatgcaaacggcgtgcggatcgcagaacttgacgaaatgagttatcgcagactgctgtgggatcacagaccactgacggatttctggagagtcggtggtggttaccggaaaaaactagaggcggcaggactgtatacgatgggggatattgcacgctgttccttaggcggtgaacaggatttttataatgaagattttctttataaaatgtttggtattaatgcagaacttttgattgaccacgcgtggggatatgaaccgaccacgattgacctgatcaaagcgtacaagccggagacaaacagcatcagttccgggcaggtgctgcagtgtccttatgagtttgaaaaaggaaaactgatcgtccgggaaatgacagatctgcttgtgctggatctggtggaaaagcacttagtcacagatcagatggtgcttacgatcggctatgatattgataacctgacggatccaaaacggagaaatgcgtatcacggggaagtgaccattgaccgctatggaagaagggtgccaaaacacgcacacggaacgatcaatctgaaaaaccagacatcctccacgaaacagatcatggatgcagtgatggagttgtatgaccgtattgtaaatccgaatcttctgatccgccggatctatgtggtagcctgcaggttatcggatgaatcatcggcaaaacaggaagatacgtttgaacagcttgatctgtttacggattatgcggcattagaacagaaaaagcaggcagaaaaggtaaagaaggaaaaagagagaaaactgcaggaggcagtcctcagtgtgaaaaagaaatatgggaaaaatgccatgctaaaggggatgaatctgcaggagggggctaccagtgtggagcgtaaccggcagatcggagggcataaagcatgaaagggaaaaatatatttcaggaaaaagaaacacataaatatgatgatatcatccatctgccacatcatgtctcaacaaaacatccgcagatggcgttattagacagggctgcacagttttcgcctttcgcagcacttacagggcatgaggactctatccgtgagacggcaagacgaacagaagcattcttagaactcgatgaggacaaaaaagaacagcttaatgaaaaaatgcatgttttacaggaatatttttcggaaaagccggagattatggttacttattttgtgccggatgaaaagaaagccggtggggcttatgttacgcatcgtggcaggatacggaaaatagatacttatctgcgcagacttttatttgaggatggaacggaagttcacatgcagtatatttttgaaatggatggcgaaatatttggggatacagagtgaaaaggacagctgggtaaatttgacaatcaatatttcggatggtataatctccccgataatagggacttttgctctatgaaagaatatggatgagttaaggagcttgtgaggcatgaaaaatatatggcgtatttttagcggagatatgaagagactggtgcggaatccttttgcgctggtgatcgcgatcggtctttgtatcataccttcgttgtatgcgtggtttaatatatactcaaactgggatccgtacgcaaataccaaaaatatcaagattgcagtagccacagaggatacaggttaccagatggatgacggaactactgttaatatgggcgattcggtcattgagagtttgaaggaaaatgataagatcggatgggtgtttacagatacaaaagatgcggctttagagggtgtatacagcggcgaatattatgcagcggtcatcatcagctctgactttacatacagtatgtataatgtatttcgtgaagattttaagggaccgaccatctcttattatgaaaatgaaaaaaagaatgccgtggcgacaaagattacggattctgcggtgtccaccttaaaacagagcatcaatgagcagttcatagaagtacttacaagcaatatatttgagcagacaaatcatatttccgaacagatggaagagaacgataagtttgcttattttcagaataaactggaaaatctgaatgaaaatctgatcggttacagtaaaatgatcgatacgttcattgccggaaattcggaactttcccaggcagttgcagaggcgaaaggcagcatcccgggactcagtgacaaggtatccgacggtgcaaagagttttggtacggcgagaagcagcctggatgatacaaagacatccttaaaatcattcagtgaaaatgtgaaccagaccatgacaagcatcaatgattctatgaataaaattcaggggagtatcaatgcgacgaatcttgccggggatgcacagcagacggcagacagtctgaatcaggcagcactggatgcagtggaactgcagcgggaactgaaccgtttgcaggaacatttaaaaaaagtggtcgttgaagatagcgtgtcggatgcagaccgtaccgtcattcagaaaatcattgagacgattgaatcgatcaatggcggggcaacagatattgaaaaagcgatcagcagcattaatcagatcgcaatgggattctccggagattcccagacggatacaatcaatacacaggtatctggcagtatggttgcggatgcaatcaacaaatcgttgtcggatatgacgcaggttctcaccacctgttcacaggcaatcacaaatatgcaggaaatgtatacgacaagcctggttccacagttagataatgtgatcgacagcatgagtcagatgttgaacaatgtatcagatattctgacaagactagatgacacgttaggagatatgagttctgtattttccggcattgagacgaccgctacaggagcaaatgacagtttagaacagattcagacggttatcgatggtgtgagtgaaaaattaacgaagctgttagaccggttaaattcggttgaggatgatgaaaaagtacaggcatttatggagttcatgaagggcgatccggaaggatatggtgagtttttctcccagccggtgctggttacgacagaggaggtttatccgattccaaactatggctcggcaatgactccgttttacacgattcttgcgatctgggttggaggaacgattctcgtcgcgctgatcaaggtgaaggcagaaccgaaaaatctgaaaaatgtaaaatcctatcagctcttttttggaagatatctgctgttttttgtgatgggacagttacaggcactgatcattgtattaggagatatctatatcctgcattgtcagattttatatccggggtggttctggctggtggcatcgcttgccagcgttacatttacactattgatctattcacttgccctttcattcggtgatgtgggtaaggcacttgcggttgtgatcatggtaattcagattgcgggatccggcggaacgttcccaattgaacttttaccggcagtttaccggaatatctacatatttttcccgttcccatatgcgatcaatgccatgcgtgagacgatcggtggtatgtatggaagcgattatatgaagaatctggcggaactgatgatctttgcggtagttggacttctgatcggacttgtaatccgtattccgtttgtgaaactgaatcactttgtggaaaaacgaatggaagatacaaaaatgatgtagcggaagcaaagcgtgaaaagcaagtcttttttatagatagcagaattggagagagaagaatggaagaaaaaagcagatacgaggaaatgtatggaaaactcgttgcatatgaacagaatatccatttgcagaatcagaaacggatcaagatcggactcaaatgtattgcgatcattccgcctatatttttgatcctgttattctggacagacagtaacaaggtggttttcctgattttatggatcgtatcattatttgcacttgcaacttatctgatccttgtagagtatgtagattataacctgcaggagaagctaaacgaactgcgggatgaagaggataaagctgtggatgttcttatgggaaaacagcttgacgaagtagaggaaaatattaagaatgccattcagaaattagatgaaaagtttaattccgaggcagagatacccaaaataacagagagtgatacaaaggagaaaacagaatgaaaaatatatttaaaatctttatctccgatgtgaaacggattttccagaacgtggttgcggttgtggttatcatgggactttgtgtgattccatgcctctatgcatggtttaatatattttcaaactgggatccgtatggtgaaagttcgacttcaaacctgaaggttgcagtggtatcagaagatgaaggtgtaacggtggcgggtatttctgtcaatatcggttcatccgttgttgaagcgttacaggaaaacaaggttatgggatgggtatttactgagacatccgacgaggcggtggatggtgtatacagcggtgaatattatgcggctcttgtgattccggatgattttacggaggagatgatcagcttccttggtggacagatcgaacacccggatattatttattatgaaaatgaaaagaaaaatgcgatagcgccgaagattacctcaaaagccaaaacgtctgttcaggaacaggtgaatgcaagcttcgtgagcacacttgcggaggcaatgatgcaggtcggggatgcagttgcgggaaacgatgttgacggaggttcacttgcggatacaattacgcagcggttaaacgatgtaagcggtgatctgcagagctacatcaacatcttaaattcatttgcaagtattttaaattctgcacagagtatcgtcgcaacaagccaggtcatgcttccgggacttgattccatggtttctacaggtcaggacacggtaaacagcatggaaagtctgatacttgccggaaatgcaacgacggatacggttacccagatggttacatacagttttgatctggttgagaacagcctgaataatgtgtccatggtgatacaaaatgacatggaaaaactgggaaaatacgaagatgcggcaggaaacggactgaatgcgacaatatccgtagtgccttatctggaaaaaatgtttaatgactcggtttcaagctgggaggggccagcagatgacgagacaagaatgcagatccagggtgtgcgtgaccagttaaagatgattgaacttgaactgaacggacttgcagaaaacggaactgccacagcggaggatatcaataccttaaaaggacagattacaaccgagattgaaaattgtaagacggctctggatgcgctgcagcatacgtttgagtataccgtaaaaccacagcttgattccacgatgaatgcaatgcagaattccatgatcgcaacgacatcgattttaaacggaatcaatgcggattttggcgatgtggaaaaggtgctgtcaaaatacgaggacacgctctcaaggggaagtgcagatttatatgattctttagaaatggcgcaggagttatataataaactgacgcagatcatcgcggatttcaccacattgagacaggatgaacagtatcaacagtttatggagatattagagacagatccacagcagttgggcagtttcatctcttctccggtaaatcttgacactgtcggaatttatgagattgaaaattatggctctgccatggctccgttttatacgattctggcattgtgggtaggtgcactgattctggttgcgattattcatgtgaaagtagaaccggaagagggcatcacggatataaaaccatatcaggcatatttcgggcgctatatcctgtttttcctgatagggcagacacagacactgatcacggtgcttggagatttgttttatgtgcggatacagtgtcataatccattcctgttctggcttgccggagcagtcagcagttttgtatttacgctgtttatttactcgcttaccgttgcatttggaaatgtcggtgaggcacttgcaatcgttgttatggttatccaggttgccggtgcgggcggaacattcccgattgagacattaccgcaggtataccagtcactttataaatatctgccattcccgtatggaatgaatgccatgagagagacaatcggtggaatttatcagatgaactactggatctatgttggaaaacttgcaatttatctggtcgtttcgctggtcattggacttcttattgcgataccgttccgtaaactgaaccatgtcattgaaaagagcaaggaaaacacggagatcatgatctgatcccacacgaaggagcttaaaatgttactgattcgaatggtattacttttgacaggacttcttatgacagttgtgccgggggcgtgcacgagaaaagaccagagaggtgatctgaatgcagaaaaaaggatacggcagattggcatctggtttgtggcagcagcggtcatatggattattaccgcaaaatttttctgaaaatcgactatgatttcgggcagatgaaaaattgtttattgacaaaatatttcgatgtgatatcatagctttagtgtgatgtgtgattaaagtattaaactattggagatgcagaatgagaaaacaggtattatctctattagtggagaataacccgggcgtgacaagtcatatttcaggacttttcagcagaagaggttacaacattgacagtttttcttccggcgtgaccgcagatccgagatatacaaggattacgatcgtcgcgaccggcgatgaacagatcttagagcagattgaaaaacagcttgcgaagctggaagatgttgtagacatcaaaaaacttgaaaatggttcatccgtgacgagagagctgatcttagtaaagattcgtgcgaaagatacagaacgtcagccaatcttaaatgtaaccgagatctttcatggaaaagttgtggatgtaacccacgattcgatggtgatcgaattgacaggccatcaggacaagctggatgcatttttagatcttctgtccggatatgagattttagaacttgcgcgaaccggactgaccggattgtcgagaggcatttccgatgtcgttatgttagacgaagacggcaaaagagtatcattataacaaaataagcagataagaatatgcaaatacatattttttattaagaaaccaaaattggaggaaattaattatggcagcaaaaatattttatcaggaagactgtaacctttcactgttagacggaaagacgatcgcaatcatcggctacggcagtcagggacatgcacatgcattaaacttaaaagattcaggatgccatgttatcattggtctttatgagggaagcaaatcctgggcaaaagctgagaaacagggatttgaagtatatacaacagcagaggcagcaaagaaagccgacatcatcatgatcttaatcaacgatgagaaacaggcagatatgtacaaaaaagatatcgagccaaaccttgaggcaggcaacatgttaatgttcgcacatggtttcaatattcatttcggatgtatcgtacctccaaaggatgtagatgttaccatgatcgctccaaaagctccgggacataccgtacgttctgagtatcaggttggaaaaggaacaccttgtctgatcgctgttgagcaggatgcaacaggaaaagcacaggatcttgcattagcatatgcacttggtatcggcggagcaagagctggtgttcttgagacaacattccgtaccgagacagagacagaccttttcggtgagcaggcagttctctgcggtggtgtttgtgcattaatgcaggctggttttgagacattatgcgaagctggttatgacccaagaaatgcatacttcgagtgtatccatgagatgaaactgattgtagacttaatctaccagtcaggtttcgagggaatgagatattctatctccaacacagcagagtatggtgattacatcacaggaccgaagatcatcacagaggatacaaagaaagcgatgaaacagatcctttccgatatccaggatggtacatttgcaaaagatttcttacttgatatgtctcctgcaggacgtcaggttcacttcaaggctatgagaaagaaagctgcagagcatccatcagagcaggttggtaaagagatccgtaaactgtacagctggaacaacgaagaggacaaactgatcaacaactaatttttagctgagtaatgagacaatggatatcatactttagagtatagatttattgttggaaagataaaagaaagaatcatcatgtggtacatttcatatgatggttctttttttaccttaagaacttgtgaaccggtatcagaaaaacttttatgacagctggaggaaacgtttccggcagggcggttggtacttgacaaaaccatggtatatgataaaataaatcatgttgtgaataaaatacatcagactttgataaggaatagtaagaattttttatttttcagagagctgccggatgctgcgagacagtaaagaaaaattcccaactcgcctttgagtccttttgcccaagctatcagttaggtttatagtgtgtaagcaaaagcgtgttgtccgcgttaaggatcataagagcgtattgtcttgttttcatgttaaaattgatctgacagatgagcagatggattttaaatattgacagatgggaaatgaaatcaaaagaatacgaattagagtggtaccacggagtaagatagacttcgtctctaagaggatgtgcaattttaaaagcatatcttcggagacggagttttttttcgcaaaaacaaggaggaaaatcctctcctcgccatagggctcggatttttcttcgaaaaacaaggaggaaaatcctctcctcgtcaaaggactcggattttgctccgcaaaacaaggaggattatatgtcagaactttacaatcacaaagtcgttgagaaaaaatggcagaaagtctgggatgacaataaggcttttgctgcgacagacgactacagcaaaccaaaatattatgcactggtagaattcccatatccgtcaggacagggacttcatgtaggtcatccgagaccttatacagcacttgatatcgtagcaagaaagcgcagaatgcagggctataacgtactgtatccgatgggatgggatgcattcggacttccgactgagaactatgcgatcaaaaataagatccatccgaagattgtaaccgagaataacgtaaagcgtttcaaagagcagcttcattctttgggctattctttcgactgggacagagagatcaacactacagatccgagttattacaaatggacacagtggattttcttaaaactgtttaaagcaggacttgcttacaaaaaagagatgccgatcaactggtgtacttcctgtaaagtaggcctggcaaacgaggaagttgtaaacggtgtctgcgagcgctgtggtgctccggttgtccgcaaggtaaagagcgagtggatgttaaagatcaccgattatgctgagaagctgttagagggattaaatgatgtagattatatcgaacgtgtcaaggtttcccagaaaaactggatcggtaaatcacagggtgcagaggtagactttgcgatcgccggaaaagaggacaaactccgtgtttacacgacacgctgcgatacattatttggtgctacttatatggtagtttccccggaacatccgattattgacaaatacaaagatgaattaaagaactgggatgccatcgctgcataccgcgaggaagccgcaaagaaatctgactttgaacgttctgagcttgcaaaagacaaaactggtgtggaaatcgacggtcttatggcagtcaatccggtaaccggaaaagagatcccgatctggatttccgattatgtattaatgtcttacggaaccggtgcaatcatggcagtaccggcacatgatgaaagagactgggaatttgcaaagaaattcaatatcccaatggtacaggtcgttgcaaagaacggcgaggaagttgatatcaacgaagccgcatttacggacgttgcaaccggtgttttaatcaattctgagtttttaaacggattggaagtaaaggatgcaaaggcaaaaatgatcgcattcttagaggaaaaaggcattggtaccgcaaagactaactataaattaagagactgggtattctcccgtcagcgttactggggtgagccgatcccgatcgttcactgcgataaatgcggctatgtgccgattgatgagagcgagctgccactgatgcttcctgaggtagagagctacatgccgactgacaatggagagtcgccgcttgctgccatgacagactgggtaaatacgacctgtccttgttgtggaggtcctgcaaagagagagacagatactatgccgcagtgggctggatcttcctggtatttcttaagatataccgatccgcacaatgatgaggcacttgcaagtccggaggcattaaaatactggatgccggtagactggtacaacggtggtatggagcatacaacactccatctgttatattccagattctggcataaattcctctatgatgagaaagtagttccatgtccggagccttaccagaaacgtacttcccacggaatgatccttggtgagaacggagagaagatgtcaaaatccagaggaaatgtcgttaacccggatgatatcgtaagagagtacggtgcagataccttaagaacttatgagatgttcattggagcatttgatttaagtgcatcctggtctgaggatggcgtcaagggctgccgtcgtttcttagagcgtgtatggaaattacaggatatcatgacagatgaaaccggatattccaaagaacttgagacaaagatgcatcagaccatcaagaaagtcagcagcgattatgaaaatctgaaatacaataccgcgatcgctgcaatgatggctttgattaacgagttctataagaaaaatgctgtgactaagggcgagtatgagacactcttaattctgttaaaccctgttgctccgcatatcacagaggaactctggcagatcattggcggaacaggttatgtataccagcagaaatggccggaatttgacgaggcaaaaacagttgaaaatacggttgagatcgcagtacagatcaatggaaaaacgaaaggaacattggcaatcggcagaaatgacgcaaaagatgatgtgattgcaaaagcaaaagaatcaattgcagataagctgactggaaacattgtaaaagagatttacgttccgggaagaattgtcaatattgtaatgaaataagatgaaaaaaggaacaaacttattagagggttccatctggaaggggattgtgtcatttgcaatccccctctttttagggaacctgtttcagcagttatataataccgccgattctctgatcgtcggtaattttcttggcagtgatgctcttgcagctgtcagttcttccggcagtctgatatttctgatggtcggcttttttaatggaattgcagttggtgccggcgttgtcatttcgaaatattttggagcagcagattatgaaggattgaaaaaagcagtacataccaatattgcatttggtctggtgtccggctgtatcctgacagcggtcggaatgatattggcaccccagattcttgtattgatgggaacgccggagtcggtgctgccaaactccattgtatatttcagggtatattttgcgggatcggtcgcatttgtcatgtataatatcgtgatgggaatcttgcaggcggtcggggacagcagacatccgctttattatctgatcttctcatcgattgtaaatattgtactggatttattgtttgtaggtttactgggatttggcgttggtgctgcggcacttgcgacgatcatctcgcagttttccagcgcatttttatgtatgctccgtctgatgcgcaccaaagatgtctatcaggtacagatctcacagatccgttttcataggggaatgttgggacagatcatcggaatcggactgccgtccggtatgcagaactccatcatttcatttgccaatatcatcgtgcagacgaatatcaacaaatttggtgtgatggcagttgcgggatgtggtgtttattcgaaaatagaaggatttgcatttttgccgatcacctgttttgcaatgtcgctcacaacgttcatcgggcagaatctcggcgcaaaacagtatgacagggcaaaaaaaggtgcgtattttggcattacctgttcgacactgcttgcagaagttgtcggtgtgatcgtattttttgcgatcccgcagcttgcagcggcatttaacaatgaagcgcaggttgttgaatttgcgaccagacaggctcacatagaagcatttttctattgctttctggcattttcgcactgtatcgccggtatcatgcgcggtgcgggaaaatctaccgtgccaatgtttgtcatgcttgcatcctggtgcatcataagaattacatacatcacggttaccgtgcattttatcccgaaaatccaggtcatcttctgggcgtacccgctgacctggtcgatcagttcagtcatctttttaatttacttcttaaaagccaactggctgtatagttttgagaaaaagtaaagtttattgagccagttggctttgcgaatatggctatatagttttgaaaagaaataaagtttattgagccaattcgctttgccaacctggctgtatagttcatgataatagaatgttcgcggagcgtgcattctattatattgtatctgttaaaagtttttataaaaccggataaattccccaagtgttttggaaggttttgtcgttgttttataggcaaaaccgacctcacgcttatggattgggatgccaagcggaatctccactaaggcgccggaggcgagatcctcttttacaaaacttttgatgacgcaggcaacgccgacaccgatacgggcaaagtcgatcagaagatccatgctggagatgtcgatggattccttgacctgaatctggttgtcagaaagatagtcgtcgatatattggcgtgtcatattgtttttatcgagcagcatcagtgttgagtttgtaaggatctgatccttgtggacgccgcgcgcgcgcaaattccgcagatagtctttggtgcagacaaagatatcttcgatctcttcgagaaaatcaaaatggatattttttaaattatccggttttcctaccagaccgatatcgatcttattgtcctcgagcagttcaagtgtctcgttggtcgactggcaggtgatggagatagagacatgcgggttctgtcttataaattcctgcaaataaggaagcagcagatatttacagagggttgcgctgacaccgatctttaagtgtccgacaccgagctcaatggaacgttttaatttttcctcaccgagggttaaagtctcaaaggcactgctcacatggtcgtagagcagttttccctcatcggttaagacaacgccgcgcgaacttcgggaaaacagcttgcagccgacaccttcctctaatttctggatggatttactgatggcaggctggctgatgtagagttctttggcagcctttgaaatgttgccggtatttgcaacggtataaaaaatccggtaagatgataaattctggttcatgataaaattcctttctgatactggatacatcgataatttttctcattataccatgaagtttagttatggtaaatatatttaatatgtatttttattatagtaacacctgtgttagaataacatacagataggacagcgaatgttgttctacacacacatcacacaaaaaacgggaacgggcacacaccattcctgacacagattttaattttttaggaggatatacccatggggatgacgatgacacagaaaatccttgcagctcatgcaggacttccatcagtcagtgccggacagcttatagaggcagatttggatctggttttaggcaacgacattacttcaccggtagcgattcatgaaatggataaaatgaaggtggacggtgtctttgataaggataagatcgcacttgtattagatcacttcgtgccgaataaggatatcaaatctgcacagcattgtaaatgcgtcagagagtttgcatgccggcatgatattacaaattattttgatgtaggagagatgggaatagagcatgcactgctgccggagaaaggtcttaccgtggcaggcgatgttattatcggtgcggattcccacacctgtacctacggtgcgctgggtgcattttccaccggagtcggcagtaccgatatggcggctggtatggcaaccggaaaagcatggtttaaagtacctgcagcgatcaaatttgtcctgaccggcaaacctgcaaaatggatcagcggaaaagatatcattttacatatcattggaatgatcggtgtggatggtgcactctacaaatcaatggaatttgttggagatggcatttcctacctttcaatggatgatcgttttacgattgcaaatatggcgatcgaagcaggtggaaagaatggtattttcccggtagatgatctggcaaaagagtatatggaagcacattcaaaacgcccatatgttgtttatgaggcagatgaggatgcagagtatgaggaaacttatacaatcgatcttagtactttaaaacctacggttgcatttccgcatcttccggagaatacaaagacgatcgatgaagtcggtgatattaagatcgaccaggtagtgatcggctcctgtacaaatggaagaatggatgacctgcgtgtggcagcatctattttaaaaggcaaaaaagtagcaaaaggattgcgtgtgatcgtgatcccggcaacacagaagatttaccttgatgcaatggaagaaggactgcttaagacctttatcgaggctggtgcagtcgtgagcacaccgacctgtggaccttgccttggcggttatatgggaattcttgcagagcatgagcgctgcgtttccaccacaaaccgtaacttcgtaggaagaatgggacatgtggagtctgagatttatcttgccagcccggcagtagcggcagcaagtgcgattaccggaaaactttccggaccggatgaagtagcataggtttaagaaaaaggagagtaaacatgaaagcagcaaaaggtcatgtattcaaatacggagacaacgtagataccgatgtcatcattccggcaagatacttaaattcttctgatccgaaggaactggcattgcattgcatggaagatatcgataaagatttcgtgaaaaatgtcaaagctggagatatcatggtggcaaataaaaactttggatgcggttcatccagagagcatgctccgatttctataaaggcagccggagtaagctgtgttattgcagagacatttgcacgtattttttaccgtaatgcgatcaatatcggacttccgatcattgaatgtccgcaggcggcaaaagagatcgaagccggggacgaagtggaagtcaactttgacacaggagtgatcacggatgtgacaaagggtacctcatatcagggtcaggcgttcccgccgttcatgcagaaaattattgactgtgagggactggtcaactatattaaccagaaataaaatgaaaatcaatgaataagaaaatccgtcaaagactgggactgcatttctatgcagtggggctttggcggatttttttgttttgtcgtaataaagaaaatgtgtatcattttgtgcatgaaatgatcaattaagtctatatgtttctataaaattttcaaatataataggaatcatcctgcatggttttcgaatctgtttgtttcagtttacggtattgcaggggtgacatacctgtattctttcggaaaatctgcgaaaaatacgactgtgatgaaaaacctgtgctggatgcaacttctgcaatcgagcgactggagctgagcaatagttctttgcttgcagcgagtctggtttccatcaggtaattgatgggggatgttccaacatactccgtaaaagaatgtgataaataaaatttgttgatatgggtgatttcagcgagcagatctaaagtaatattttttgcataattagcatcaatatattttttcgcaacaaaacattcctttgatatttgcaaagtggtatcagatatgacagaaagatgctgttcgcgtgtaatataaacaagcaaaacctgtaggagaccatgacagattgcttcaaaacctggctttcttgcattaaactcttttatcataatctgggaaaaattaataaagtgtgttttggcggaaccataattatagtagctgtatccttttgggttagcagcgttttgggaattaaaatagaaagcgagcccttctacaccaaatacaatataggtcataggatcgtttgacatcgttttttccgtatgttcaatatgtggatttatgattatcagatcgtctgcacatacagaaaccgtatcattttcaatgtaaaatacaccttttccactgataacatagaaaagttcagaaaactgatgggtgtgagggtggctttgccaatccccttcgtatttagaaatagaaatataacgaagtttaaaatccggatcgggtactcctttgtactcaaaattaattaattcattactcatttgtattatcttcctgttgtatcaaattttatatcttatagattaaaaccgcaatattactaaaataatgttgtgaaactgatgaataaaatagcaattaaatagggtttcttattgcaagtatacagtaatttatgataaatgcaaatattttattgactataaagcaagatatataaaaattagagcaacataaaaattgaagcagttgatgcagacagatatacttaaaaacatcaggtgatgagacaagaaaggagaagacaggaatgacaaaacaaacaggcagactgacattgccgaccgatgcagacattgtcgaggaaaccatacgattgaaaaatcttcttggagcagatgcattgcgtgactgtgacggaacggagatgccggatgcgttattgaatgagccggtaaagaaatatgcaacgtattatacgaccagaaaggataatgcctgggccgagcaaaatccggaagagattcaacaggaatacctgatcagcaatcgtgtaactgcaagaagtgaaaaactatgtataagattgatggaaggatttcatacacagcagttaaaagtcaatacgttggatgatcccaaaagatggtgggaagtaattgatcgcacaacgggtgaagtggtttctgtcgatgactgggaatttaaaaaagaactggaagaagttgaaataaaaaccattccttatcatgaatatacggtaagttttctggcgtttttaatatgggatcctgtacatatgtataactttattacaaatgattggaaagatacaccacatcaactgacatatgatgtgcggcagccgaaaacccagaagtacgtaaaagaaaaattaaaacgctggtgtgaagaaaacccgcagatcgacgtggtaagatttacgactttttttcaccagtttacacttacctttgatgataaaaaacgtgaaaaatttgtagaatggtttggatatagtgcaagtgtaagtccatacatattagaaaaatttgaaaagtgggcagggtataaattcagaccggaatttattgtggatcagggatatcacaacagcatgttccgtgtgccaagtcgtgagtttaaggattttattgaattccagcagcaggaagtttgtgcgcttgccaaggaacttgtagatattgttcattcctatggaaaagaagcgatgatgtttttgggagatcattggatagggacggaaccatacggaaaatattttgcagaaattggtctggatgcagtagttggttctgttggcagtggtgtgacactccgtatgatttcagatataaaaggggttaaatatacagaaggaaggcttttgccatattttttccccgacgtgtttggagaaggcggagatcccataggggaggcaaaggacaactggatgaaagcgagaagggcaattttacgttctccgcttgaccgcatcggatatggcggatatttaaaattggccagtgaatggccgggatttatagaagagattcaaagtgttgtcggggaattcagacagatacatgaaaatatgaacgggacgaaatcttatgttgcaccatttaaagtagcagttttaaactgttggggaggtttgcggaaatggatgtcaaaccaggtgcatcatgcaatatggcacagagaaacttattctgcagagggagtgctggaatgtctgagtggaatgccgtttgatgtggaatttatctcttttgatgatgtgaaaaaaggaatcccaaaagatatcagggtgatcatcaatgttggagatgcatatacgtcattcagtggagctgaaaattggattgatgaagcagttgtaacaacgttaagacagtttgtggatgaaggtggtggatttatcggagtaggagaaccgacagcatatcagcatcagggaagatttttccagctggcggatgtgcttggtgtagatcgtgagatgggtttttcactaagtacagataaatataacgagaaaaatccgcagcattttatcttggaagatattgaaggggatattgatttcggagaaggtacgacccgcatttatgcgcagggagatcattatcagattcttgcaatggatggagaatacagccagctggttgttaatcaatacggaaaaggtcacggtgtttactttgcaggattgccgtattcccctcagaactgccgtattctgcttcgtgcaatttattatgcagcgggaatggaacaggagatgaaacgatattacgtaacaaatgtagatactgaggtcactgtttttcagaaaacgcaaaaaatagctgtcataaataattcaggaaaagaatgtcagacagatctgtatatcaatggcgattttatcgtaaggttgacactagaaccaggagaaatgcggtggttgaatgagacaatgtaactattgataatttatgagtggtatcataccgtcatattttataaaataaaaaaataataatttttgcagggaggtattttttatgaagaaaaaagcattgggattcatgttggcagcaactatgacagtatctgtgtttgccggatgtggtgggaaccaaaatgaaggaaacacgaacgaaaaagaaaatgttacgaacagtaatgaggatacgcagagtgtttccgcagaaacaaatgaaaatggagatgaaacacttacggtatggtgctgggatcccacttttaatatttatgccatggaacaggcagaaaagatttatcagaaagaccatccagattttaaactggatattcaggaaaatatttataatgatattgagacaaagctgattacagctgcaacgtcaggagattacagtactttaccggatatttttctgatgcaggattattcattccataaaaatattgccaattttcctggaatttttacagaattaacagattccggaattgatttttcacagtttacagagggaaaacttgcagattccacggcagagggaaaaaattatggacttccttttgataatggtgcaacgattatggcaattcgttcggatatggtagaggcggcaggtcttacggttgacgattttaaggatactacatggtcacagtttgaggaacttgcaaaaaaagtagtagaggcgaatggagtgccaatgatcgcttcctccgggggatccgaattacttatggaaatgctgcagtcggcaggagcctcaccaattgttgacggaaaggttcatattgcagacaatgaagcgttaaaaaagacaatggaagtttataaaaaattagttgatgagggtattattgccgagtatacggactgggatcagtatattgcctctatgaatgacggaaaaacagcaggagtgatcaatggatgctggatcatgtcatccattcaggcggcagaggatcagtcaggaaaatgggcaattgtaaacatgccaaaactggatggagttgatggagccacaaattatgcaaattgtggtggtgcaagctgggcagtatcttctaactgtaagaatacagaacttgcatttgatttcttaaaatctacatttggaagcagtgtggaattatatgatgatctgttgccgaatgcaggtgcgattgcaagctacattccggctgcacagtctgatgtatataatcaggcatcagatttttatggtggacaggcagtatataaagatatcgttggatatgcaggttcggttccagcatttgactgtggtgcatactattcggacataagaagtgcattgacagatgcaatcacaaatgttgttcagaataatgctgatattgacggtgaaatgaataatgcacaggaaacattagaatttaatattgaaaattaaatatgtaaagtggtttgtaccgggaacaaattttatgttcccggtattacattaggagaaaatatatggagaaaaaaagaaaattaagtctggaaagaaaacataacctcactggttgggcgtttttgcttccggcagctatattgatttttgtattttgtttttatcccatgatacaggcgcttatgctgtcatttaagaatggtatgggagattctgtaaggtgggttggctttgcaaactatgtcaggatactgaaggacaaaacatttttgcagtgccttttcaatacagtattttattttatcatacaggttccagtcatgttgatcattgcccttgttcttgctcaattactgaacaatccgaatataaagggaaaaggaatctatcgaactatgattttcctgccatgtgcaacatcactggtatcgtattctatgatttttaagtcactgtttgcgcaggatggtctggtaaatcacgttatttctgcgattggacttccgaccgtagactggtttcagaatgcatgggctgcaagatttgtaattataatcgcgttggtctggagatggaccggttacaatatggtgttttatcttgcagggctgcagaatattgattattccgtctatgaggcgagtcgtattgatggggcatcaccgtttcaacagtttacaaagatcaccattccactgttaaagcctaccatattactgacggctattatgtcaacgtctggaacactgcagttgtttgacgagtctgtaaatttaacggctggtggaccgggaaagtcaacaatgacattgacgcattatatttataacatttcttttgtggagacaccaaaatttaattatgcggcagcactttcagtgtttatccttattatagtggcaattttgtctgcaattcaaatgaaagtaggtgacaaacgtgagtaaaggaaaattatgtatatcacatattgtattgatttttgcaagttttttgtctgtatttccactatattacatggtttgtggtgcaaccaatcaaagtattgatgtggtcaggggaaaactgcttcctggaacatatttagtcgaaaattttaaggcattgattgccaatcagaatctggggctggcaatgatcaattcatttcgaaatgcgattcttatgacgattatcacattattggtctgttcaattgcaggttatggatttgaaatttatcatgataagggaaaagacatattgatgagtgtattgttgttagccatgatgctgccatttgttgcaatcatgatcccgctttttaaaatgatctcttcctggaatctggtcaatagctggattgcatttgttttgccgtctatttcaacgccatttatgattatgatgttccgtcaggcggcgcggtctttccctcatgatattatagaggcggctcgtctggaggggctaagtgaaatacagatttttttccggatgtttgtgcctgttatgaaatcaacatatggagctgcaatgacggttacttttatgaacgcatggaatagttatctgtggccaaagattgtctttcaaaataatgattccatcacaatgccaatgcttgtggcaaacttaaaaagcggctacagtgttgattatgggatgttgatgctcggtgtactgatctgtacacttccgacggcgattattttcttatgtctgcagaaaagttttgcaaatggaattacgggggctgttaaatgatagaaaaaagatactgccttacaccagaagagtgggcatatgcgaaagccgaacttgttcttgcagaaaagctggggttgattgaaaacgccggtatagaggcgttggaaaaaagatgtgcagaaaaaaatgaagagaatgccaggcttgaaatggagaaaacggtattttacggaccgcgcagatattcattgccgatgtatctacagtatgaattgacgcgtttccggttggattttgtacagccgacagaaaatattagaaaatcaggaatcagtccggagattacagaaaatcagaaaaaagctttctatgaacggaataaagatttatttggaagatattttggagatcttttttcttatgaagaggtagagcagatcattgaaaaaagattgcgggaggaagtgtatgacagacttgtgcaggaaatattatgtcgattcgataaacggaagtgataccaatgacggtttgagtgaaaacagtgcattcgcaagtctttttgccatcaataggcttgcactaaaaccgggggatcacatattgcttgcgtgtggaagtgtttttgaaaaacagtttttacagattcgtgacagcggaacaaagcagatgccgattgtaattggaagttatggatgtggtgaagatcctctgataaagacagacggacagggaatctggtatcaggattatggaaaagaactggattcgccgacgcatgtttaccatggttatgtttcctcggcagtacttctatttgatgccgagtatattatcatacaggatattgagattacaaacagtgcggataaagtgatcggcgaaaattattcacaggcagataaaatggagcgtacaggtgttgcagtcgttgcaaaagagaaaggtttaagatgtggaatcacacttcgaaatcttaaaatccatgatgttcatggaaatgtttatgacaagcatatgaataatggcggcatctatatgacagcattacagccagcggaagaagcaatgacaggagtggcaagattttcagatatcctggtggagggatgctatgtatatcgtgtgagccgttgggggatcgcagtcgggtatagttatgcacatgagaaatttgcgggtgcagaactggataaaaaaaggtttttgaaatatggtcatgagaatattgtgatacgggataattatgtgaaaatggcaggtggagatggaataacggtcatgtatgcactgcgcccgtttgtggaacataatatgaccgattctgtggcatgtgagatcaatgaccgtatttattgcaatccgggcaaccgtggtggaaaggttgctgcggcaatctggccatggaaatgtaaagatgcgttgtttcgttataatgaagtggcagacacacggctgaatcaggacgggatggcttacgatgcagattccggggatggaacggtgtatgagtataattacagcaggcaaaatgaaggcggttgtgtgatgttttgtatgcaggaggccattcataacacatttcgtaataacgtcagttatgatgatttaggtggaaccatcagcccgtccgaaaacccggatgcactgcttacagataatatattttatgttcgcaagggagttccttttgtgagaaagaatatggatggtggaaactttacggaagaaaataatcagatcatacagttataaaatccataccatggcagatcatcactccatcacctgatacggaatcttagtccccattcccgaactaaaatgcagttcataatcctccgtaataaaaacggcttctgtattatccagactttccacaagcgccatcccgtcagctaaacccagtgcaaaacaggtggtggagagtccatcaccgtccacagattcgtccgtgatgatcgaaacacccagcagtccgttatcatagggatatccggtagcagtatctaaaatgtgatgatagcgtttgccgtccacctcaaaatagcgctcataaacaccggaagacacaacggtctggtcggtcacggatacagcgagcattgcagcgccttcctcgtcaaacggacgctggatgccaatattataggaagaaccgtccggttttgcaccaagacagagcacattgccgccgaggttgatatagccgcaggcggctcctttttgattcaggtaatctttcatgcggtctgcaatatatcctttggcaattccgccgagatcaattttagcggacggatcttttaaggtgacggtattgccatcaacaactacattctgatagtctactgtcgttaaagcctttttgatctcatcatcagatgggatcatggaggcgtctgtctgatctaacaaagcctttgtggaaatatcccacagatccgataattttccaatcgtaatatcaaattttccattgcttagatctccataataaagaccttttttgatcagttctgcggtctcttcatgcacggtgacaggtgcaccgcctgctgcattgatttttgacacatcgctgtctgcgatcgtgttggaaaaataattttcataagtgtctgccagagaaaaacagtcatcgagcagggtttcgtcttttgttccgtataaggtgacggtaatgacggtattaaaataaaaacccgatttggagatcgattcgccggagccggaagttttaccaaaattgagcctggatggcagatcacaacccgatagcagtaaaaccggcatagacagcagtatacataaaaataatcgatagtttcgtttcataaaattctccatttttacctgattttcaagggaaacaacttgagttgtccgaacaacactttagcataaaaataaaaatgccacaagtataccataatatattatttttactgcaattcgttgtagatgtgccaatgcagaacagatattctctttttttcctttgatattttgtattagatatgatagagtataatacagtgcatatgttcgaaacagcataattagaaataaaaggggattcgttgggaaaatggaccagagtagttttcactttcatgagaaaaaaagagttgtagttaaaatcggttcttcttcgttaaattatgaggagaccggcaatttgaattttacaaaactagagcacctggtgcgcgagctttgcaatttaagaaaccgggggatggacgtatgtctcgtcagctccggtgcgatcgccgtcggcagacagtcgcttggcatgacagagcggccgcgggaactctctacaaaacaggcatgtgcagcagtcggacaggcaagactgatgatgatctaccagaaactgtttgcagagtataatcaggtggcaggtcaggtacttatgacaaaaaataccatggtcaatccggtttccagggaaaatgcaaagaatacatttgatgaattgttccgtttaggtgcgatcccgattgtcaatgaaaatgacacggtatctacttatgagatgcagtttggtgacaatgacacgctttctgcgatcgttgcttccctgattggagcagatcttttgattttgttatccgatattgacggattatttacggatgatccgcataagaatccggatgcaaaattgatcgaagtggtcgaaaagatggattcagacattcttggaatggcaaagagtacgaccggaagcgatgtcggaaccggcggcatggcgaccaagctgaccgcggcaaagatcgcgacactttccgggacagatatgatcattgcaaacggagcagatgtctgtgtactgcatcatatttttgatgacagctttaggggaaccatttttaaggcacagaaaaaggaaacattccgtatacaggattttatattagaaacaatcggatagaaaaagatttgtgtgaataataaatttttcatgcgcaggaatggagattttaatgaaacaggaacagattgacagaatcaacgcactttaccgcaaatcacaggcggaaggacttaccgaggcggaaaaagaagagcaggcaatgttgcgcaaagcctatgttgcagatgtaaaacgcaatctcgtagcacagttaaataacattgatatgcagaatccggatggaacagtcacaaatctcggagaagaatatggaaacaagaaaaagctctcctgacaaaaaagagatccggaaaaagcatcttgccatccgaaatgcaatgtcagaaccggaaacggcagaaaagagcagagccatctgcgaaaaattgctgacctcagactggtatgccataacagactggatcttcggatactatccgcttgggaaagaggcagactgcctggaatttcttaaaaaagcactgtccgatggcagacatgtcgccttgccccgtacaggagcagactgtaccatggaattttacgagatcacctccttggaacagaccgcagaaggcgcatttcacgtcatggaaccgaccgcagaatgccgccgtataaatcccatggatctatccaacacgcagatcacagtgttagtcccgggcgtcgtctttactcccatcggcagccgctatggctacggcaaaggcttttacgaccgctactttgcgagatatgcaaagctaaaccgctttgcattagcttacgagaaccagcttgaaccagagctggaagtacttgatacagatataaaaatgcatcgcatttacacggaaactggcgaatatgatataatttgaggctacccaaagcgaaacgctcccaaaaccttcgactgttgtgaaccgggcaccttcttttaaacaggtgcccggttcacgacacccacagcccgttgcagagtttcgtctcaagtatcgccacaatacacatagactactgcagagtttcgcccaggtattgctgcaacaccgtataaacatttcacagaaaggaaaggtatcaccatggaacttgaacaaatatgccagggagccaaagccgcatcccaaaaacttgccacattaggcaccaatgaaaaaaatcgggctctcactgcagtcgcatccgcccttgtcgccgcatccgccgacatcatcgccgcaaacaaagaagaccttgaaaatggcaaaaagaaccatatgccggaaggactgttagaccgcctgatgctaaacgaagcaagaatcgcccagatcgccgaaggtttgcagcaggtagccgctttagatgatccgatcggggaagtcctttccatgaaaaaacgtccgaacggcctgatgatcggaaaaaaacgtgtaccgtttggcgtggtcggcatgatctacgaggcaagaccgaacgtgactgtcgatgctttcggactctgctttaagaccggaaatgctgtgatcttaaagggcggaagtgatgccattcattcaaatattgcgatcgtttccgtcattcaaaagacattagagcagcttggcattccaaaagaagcggcatctttgatcgaagatacgtcgagagataccgctgcggcatttatgaaaatgaaccagtatgtcgatgtactgatcccacgtggtggggcaggactgatccgtgcggtcgtgaatcaggcgacgatccctgtgatcgaaaccggaaccggaaactgccatatttttgtggatgagaccgctgattttgatatggcggtaaacattatcatgaacgcaaaaacgcagcgtatcggtgtctgcaatgcctgtgagtcgcttgtcatccatgaaaagatcgtggatacatttatgccgaaactgacagaggcgctgcagaaaaagaacgtggaattacatgcggatgagagaagttttgctgcggcagagtcggatacagcactgaacagagcgctgatcaagcctgcggtggaggaagactggggaaaagaatatttagattatatgatctccgcaaaaacagttgcatctgtagatgaagcaatcgagcatatcaaccgctataataccggacattcagaggcaatcattaccgaaaattataccaatgcacaaaagtttttggacgaggtggatgccgcctgtgtctatgtcaatgcatcgacacgtttttctgatggattcgagtttggctttggtgcggagatcggtatcagtacgcagaagcttcatgcgagaggtccgatgggcttagaggcattgacaagcacgaaatatatcatttatggaaatggtcaggtaagaccataagaaaaagtaatagaaatagtgaggaattaacagttttatgagtcagaaagttacaacaggagtgcgcccgacactgcgcatcgcagataaaaaccagatcccggcaactgagccggagcgtcagtattactttatggatatcgcaaaagagtacttaagacagctttccgaagaaaagggaaatccgctgactttccatgtttccacattcggatgtcagatgaatgcaagggattccgagaagttagtcggtattttagagaagatcggttttgtggaggaggactccgaggaagcggatttcgtcatctataatacctgtactgtgcgcgagaatgccaataataaagtgtacggaagactgggatatttaaacggtttccagaagaaaaatccgtttatgatgatcgggctctgcggctgtatgatgcaggaaccgacggtggtggagaaaatcaagcagagttatcgttttgtgaacctgatctttggaacacacaatatttacaaatttgcagagctgatcgttacagcgttagaaaacagtttcccggagcattcgtcaggtcacggcacatccatgacgatcgatatctggaaagatacggacaaaatcgttgaggatcttccggtcgaacgaaaatattctttcaagtccggtgtcaacatcatgtttggatgcaacaacttctgcagttactgtatcgtaccgtatgtgcgcggcagggagcggagcagagagcccaaagaaatcatccgtgaggtggaacgccttgcggctgacggagttgtggaaattatgctcctgggacagaatgtcaattcttatggcaaaaatttagagcagccaatgacgtttgcacagcttttgcaggagatcgaaaaggtagatggcattgagcgtatccgttttatgacttcccatccaaaggacctttccgatgatctgatcgaagttatgaaaaattccaaaaagatctgtaaacatctgcatcttccattacagtccggaagcagccgtattttaaagctgatgaaccgccgctatgacaaagaacattatttagaactggtagataagatccgtgccgcagtgccggatatcgcgctgacaacagatattattgtcggattcccgggtgagacggaggaagattttgaggagaccatggacgtggtacgcaaagtgcgttacgacagtgcgtttacttttatttattccaaacgtaccggaactcctgcggcagggatggaagaccagatcccggaggacgtgatcaaggcacggtttgaccgtctgttaaaagaagtgcagacgatctccgcagaaaaagcaggagcgctgaccggacagacacttccggttctgatcgaagaaaaaaatgagcaggatgcgtcacttgtgaccggaagactcagcaataactctgtggtacatcttccgggaaccgaggatatgatcggaaaaatcgtggatgtgaaacttttggaatgcaaaggcttctactatatgggggagtgtgtgtaaaattctgggaagaagccttcggcttctactatatgggacagcgtgcgtaaaattctaggaagaagccttcggcttctattacatggggagtgtatataaaattccgggaagaagcctttggtttctattatatggacgagcaagaatgaagaaaaaagatattatttttttagttgtagttttcataggcttagcagggatcgcggcaggattttatctgacacatcaggataccggtgcaagcgtggaggttatagtagacggagcaatctatggaacttatccgcttgatgtggacaaggagatcccaatccagaaggacgggaaaacgacgaatctgcttgtgatcaaagatggaaaagcggatgtgacagaagcagactgcccggacaaactctgtgtgcaccagaaagctatttcaaaaacaaatgagacgatcgtctgtctcccgaacaaagtagtggtgcaggtgatcggtgccggagaaagtgagttggattccattgcgagataagaaaaaaacagcatatttaggtgtttacctggcactggcactcatctgcagctatgtggaatcactgattccgttttattttggaataccaggtgtaaaacttggactaacaaatatagttgtggttctgatgctttactgcgtgggaacgaaagaagcactggcagtgtctgcactgcgtattgtactttccggtttcctgtttggaaatatgttcagtattttatatagtcttgcaggcggactgcttagttttcttgtgatgtatctgctgaaaaaaacaaaatggtttggtgttctgcctgtcagtgtgagcggcggaatctttcacaatgtaggtcagcttgttgtggctgcttatgttgtggaaaattataatattttttattatatgccggtgctgctgatcgccggtgcactgactggatttttggtcggtattgcggcacaggaaatgataaaacggatcggaaaacggatggtgtaacaggaggattttagcatgtattcatacatcaaaggtgttttgacggatatggacgaggagagtatcgtggtggagaccggtgggatcggttatcatatttacacgacaggacagacattccggtatcttccttctgtcggggaagaagtaaaagtatatacttatctgcatgtcagggaagatgccatgctgctttttggatttctgacaaaggacgaattaaaaatttataagttactgttaggtgtcagtggaatcggaccgaaaggagcacttgcgatcttatccgtgatgacgacggatgatctcaggtttgcagttctcggtgatgatgcgaaagcaatcgctaaggcaccgggagtaggtgcaaagacagcccagagactgattcttgaattaaaagacaaactgagtctggaagatgcatttgaacagaaatttgaaaagacgggtgagtccacagaaaatcatgccagtggcactaagaatgaggcggtgcaggctttggttgcacttggatattcgtcctcggaggcgctgcgtgcattaaacggcattgagattacagaagagacggacgtagaagaaatattaaagatggcattaaagaatatggcatttttatagaaatgtggtgaaaaattaaatggaaaaaagagtcatttccacacaggtgcaggaagaggatattaaaatcgagaaaagtctgcgcccacagacgcttgatgattatatcggacagcagaaggcgaaggaaaatttaaaagtatatattgaagctgcaaaacagagaggcgaggcgttggatcacgtacttttttatggacctccgggacttggaaagacgacgcttgcgggaatcattgcaaatgagatggggacgcatcttaaggtgacatcgggtcctgcaatcggaaagccgggcgaaatggcggctatcttaagcaatctgcaggagggggatgtcctgtttgtggatgagatacacaggttaaaccgtcaggtggaggaagtgctatatccggcaatggaagattatgtgatcgatattatgattggtaaaggtgcaacagctcgtgcaatccgcctggatctgcccaaatttacactggttggtgcaaccacaagggcgggacttttgtcggcaccgctccgtgatcgtttcggtgtggtacatcatctggagttttatacggtggaagaattaaagacgatcatcctgcattcggcaaaaacacttggagtggagattgatgagaaaggtgcatttgagctcgcgagacgttcacgcggaacaccgagactggcgaaccgtctgttaaagcgtgtcagggattttgcagaagtgaaatatgatggaaagatatcgaaagaagttgctgcttttgcactggatcttttagaggtggataagatgggactcgatcagaatgaccgcaatatcttaaagatcatgatcgaaaaattttccggcgggccggtaggactcgatacgttagcagcggcgatcggcgaagattccgggacgattgaagacgtgtatgaaccgtacctggtcaaaaacggatttattaaccgtacgccgaaaggacgcgtggtaactgattttgcatatcagcatttcggattgacaaaatagttgattttaacgttgtatgtcattataatataccatatattgtgatgttcggtaaaagaaacagtaaaaactgcagaagaccggaggagaagataaatggcagagaaaacaagtgcagaagttgtgatcggcggaaaagtatatacattaagcggatacgaaagcgaggaatatcttcagaaggttgcagtctatatcaatggaaaattaaatgaatttgacagtatagagggttatcagagatttccggctgacatgaaggcaactttgttacagcttaatatcgcagatgattattttaaggcaaaagcccaggctgaaaagttagagcgtgagattgaggcaaaagaaaaagaaatttataacctgaaacacgatctgatcgcagaacagatccagtcggaaaatgataagaaagagatcaagcgtttagatacagaaaatcgagaattactgttgaataaggcgcgtttggaatcgtcattagaggagtcgcttcttgggaagattgaggatgaagatacctcagaaaaagatgaaacagaacaggaagataccgctgattaatagtagatgggtacctgtagcagagaactgccatacaggaaaaagtgaggggacggagaggttattttcgtccttttatgtttttgatggagagaatcagaatgaacagtaataaacgatatcagaatatagaattgttagcgccggcaggttccatggaaacttttcaggccgtgatacatgccggtgcagatgcagtttacctcggtggcggcagattcggtgcacgcgcctatgcgaataattttactgaggaagaactgcttctggcaattgattatgcgcatattcatgggagaaaagtgtatcttacggtaaatacattatttaaagaacgtgagttgacaggggaattatattcgtatctgctgccttattatgagcagggattagatgcagtcattattcaggatatgggggcttttcggctggtgcgggaggcttttccgggactttccatacatacgagtacacagatgaccgtgacaaaccgctatggtgcaatgatgatgaaagaactcggagcagaccgtgttgtgactgcgcgtgagatgtcctttgcggagatacgggatatcaaagatcatgtggatattgagatcgaaagttttgtccacggggcgctctgttactgttattccgggcagtgcctgtttagcagtatgttaggaggacgcagcggaaaccgtggcagatgtgcacagccgtgccgtctttcttatgaggtcatggatgagaaaaaacatccggtaaaaacggggaaaaaagagcgtgacctttacattttaagcccgaaagatctctgtacggtgtcaatgatcccggaactgatcgaaaatggagtggattcctttaaaattgagggaagaatgaaacagcccgaatatgcagccggtgtggtatcggtttatcgcaaatatatagactattacatcaatgcatgcctgcgcacggatgaggtgactgcaaagaaagatttcaaagtaacgaaagaagatatacagcatctttatgattttggaaaccgcagtggatttaccgatggatactataaaagacataatggcagagagatgatcacacttgataagccatcacatacaaaaggaaatgaagcactctgggaagaaataaaagaacagtatgtaaggtccgaaaaaaaagaaaaaatcaatggaatcttaagattaaaaaaagattgtcctgctaaactggaagttgcattaaatgatatccggacctctgtggatggagatgtggtacaggcagcattaaaacagccgcttgcggaagaaaaagtagctgcaagcataaaaaagaccggaaatacaccgtatgagtttgcagaacttgacatagatatggatgacgatatattccttcccgtacaggcactgaatgtgctgcggagaaatgcacttgaacggttgagcgaggcattgaccgcacctatgcgaagaagggaagcttcgcataaaacagaaatggcggcaggagaaacatccggcgaagaatggcagaaggaaacggtatctgtgaaaaaagagcaaaagacagagaaaggcagcgtaacaccgtatctttcggtttccatcgagaatcgttcctgtatcacacttttgcttgatgcatcttatgtagatgccatttatcttgacagcagctgttataccagggaaaatcttttcacagcattaaaagaagatgtgagccgtatccactcggcggggaaaaaggcgtattatatcatgccggcagtattccggctttctgcactttcattttatgaaaggaatctttccggaatgaagcagaccggggtagacggatttgtggtaaaaagctatgatgaacttgcgtttatccgtcagaatctgtcggatatggatgtgattttagatcataatctgtatacatggaactcctatgccaaaaagcagttttgggataggaagccggtgcgcgataccgttcccttggaactgaaccggaaagagctgcaggaaagggacaatacacacagtgagatgtttctgtatggcaatctgccgctgatggtgtcggcacagtgtgtacatgccaatgccggggctgaccgggggtgtgacaaaatgcggacagttacttatttaaaggaccgttatggaaaatatttcccggtcaaaaataactgtacggaatgttataatacgatttataatacagctccgctgatcctgttcccatatcggaaggagctggagaaaatggggatccatgcgtaccggatcagctttacgacggagcagggaccacaggtaaaacagattttacatttatatgaaaaaatatttttgaatggggaaaaaagtctgcaggaactgtatacaggcgaatataccggtggacactataaacgaggagtagaataacggtatggaaaatcttatcgtggaagtttcaaaatatctgatgatcatattgtttgcatgttatgcatatgagtgtttttcggcatttcgcagcaggatcagtacggaaaagcggaatcatatttttgacagacagatttttttaatgtatctgatccatctggatgcatttttagtgctctatacagttacggatgaaattaatctgatcattctttattttcttcaggtaattttagtgacgattgtgatcgttaattatcagttactgtatccaaaagcgtccagacttgtgacaaataatatgtgcatgcttttaatggtcggctttattatgctgacaaggctttcttacgagaaggcgatcagacagtatgcgattgcgatctgtgcatccgttattacaattgtgataccggtactgatacggaaagtgcggtccttacgaagactgacctggctttatgcgatgatcggcattgtcggacttgctgcagttaccatatttggttccacgagctatggtgcgaagatctcggttacgatcggtggcctgttttcgatacagccatctgaatttgtaaaaattttatttgtattttttgtggcaggcatgctctataaaaatacggattttaaaacagtctgtatcacaacgatcgtggcggcagtgcatgtgctgatcttagttgcgtcgagagatcttggaggtgcgttgatcttttttgtcacctatctggtcatgctctatgttgcaaccagaaaactgttttattttgccggtggtctgctggtcggatgtattgctgcagtagctgcatatggactgttttcacatgtccgtgtcagagttgtggcatggcgggatccgctcagtgtgattgacaacgagggatatcagatctgtcagtcgctgtttgcaatcggaaccggcggctggtttggaacgggactgtatcaggggtcgccgaataagataccggttgttgagcaggattttattttttctgcaatatcagaagaattaggcggtattttcgcaatttgtctgatcatggtgtgcatcagctgctttttgatgtttttaaatattgcaatgcagatgaaagaacagttttacaagctcgtggcgttaggactgggtacagtatatgcgttccaggtatttcttaccattggcggagtgactaagtttatcccgtcaactggagtgacactgccgttagtcagctatggaggaagttcattactggcaaccatgatgctgtttgcggtaattcagggactgtatattttaagacaggatgagggagaaaacaatgcgagaaaaaaacagcgaaagaccggatacgagagacaacaggtcgaagaactctactaagacaggaaaaaagaaaaagaatacaaaaaaccaggaatttgcagtgatcacatattcatttctggcactgtttatctgtctgatgggatatttttcttacttccagttttttaagagcgaggaatttatcaataatccttataataccagacaggagacatttgcacagaagatcgtgcgcgggcagatcctgacgaatgatggacaggtgcttgcggagacggtgacggacagtgagggaaatgagacaaggagatatccgtatggcagtatattttcccatatagtcgggtattctaccaagggaaaatcaggcatcgagtcactggcaaattttaatctgttacggtcaaatacagcttttatagataaagttggagacgagatgcagggggagaaaagtcctggggacaatgtggtcacaacattggattatggactgcaggcaacggcatacgatgcattggggtattataagggagcaatcgttgtattagagcctttcaccggaaagattcttgcgatggtgtcaaaaccggattttgatccgaacacgattgcagccgactgggataatctgaccgcagatgacaacacggatgcagcactcttaaatcgtgcgacgcagggactttatccgccgggatcgacatttaagatcctgacaactttagagtatattcaggaacatgcagactatgaaaattacagttatacctgtacaggcagttatacggttggaaatcatacgatccactgctatggaaacaagagccatggaacgcagaatctgcgccaggcatttgccaattcctgcaatgcattttacgcatcgcttggaatggaacttgacatcgaccagtttggacagctgtgtaataaaatgctgtttaataccagccttccgacggatctgcaggcatctaagagcagttttgtgttagataagtcagacggatcttcggcaattatggcaacttccattggacagggacagacacttgtgacaccgtttcatatggcgttgcttgtcagtgcaatcaataatgatggagtactgatgaagccatatgtgttagaccgtgtggagagcagcgacggaacactggtcgagcagtatgagccggaagaatacggtacgcttatgacaacggatgaggcagcaattttaaaagattatatgaattatgtggtggagacaggaaccggtaaaaaactgagcggtcaaagctatgaggcggcaggaaagactggatcagcagagtattctaccggtgcagattcctcgcattcctggtttgtgggatatgcacaccgggatgataaatccgatattgcaatcgctgtcatcgtggaaaaagcaggtgtcggaagtgaatatgccgtgccgattgcaaaagaggtttttgatgcatattataatgaatgaaatgttgcatgtgcttttgaaaagtattatacttattagcatgacagtattataaaaaaccacatcaggaggtattgcgatgatcgaggcaacaagttgtggtggtgtggtaatatttcgcggcaaaatattgctcttgtacaaaaattacaaaaataaatacgagggatgggtacttccaaagggaactgtggaagcaggagaagaatataaggatacagcgatgagggaagtatatgaagagactggtgtgaaagcaaccctgatgaaatatatcgggaaaagtcagtattcatttacggtaccggaggatgttgtggagaagacggtgcactggtatctgatgatggcagacagttattacagtaaaccacagcgtgaagaatattttgtcgattccggttattacaaataccatgaggcgtatcatcttttgaaatttccgaatgaaaaacagatgttagaaagagcgtatgaggaatatcaggaattaaagaagaataatctgtggggcagccacaggtatgaataaacaaaacacatcagaaagatggagcaggatgtatgatatggtataaggatttgtatgttggagaaagtattgtacataagacaaagaaggtcaaatggaagattatgcacaatgccggacagattgggatttatgtgatcacattagcctctaacacacagaatctgcttgatatcataccatcatacgaactgatgcaaaaagggtatccgaaaaaagatatggtggttgtgggactggcaaagggctatgatgaagcgattgaggtcgcagcatccattgtggatgaagtgtaccacagtaccggcacatttgccgtccgcgcctatcttgcagaaaaacaggggtaaggagcgtagaatgtcagttatattgctcatattaaaaataatcggctggatcctgctgacgctgcctgcactttttctgctgattgtttttcttgtattagttgtgccggttcgttacaggacggatggaagcatagaagaaaatatccgggttcaggggaaaatgcattggctgcttcatattctgtcgtttggcttttcttataacgaggaaggtttttcttatacgctgaaactctttggaaaacgtatcgctctgggggagaagctggaggacgaagaggaagaaccggatgcagacagtacagacacggcagtacatgagacaaaagcagaggttgaaaacatacttccatcagattcaaaaatgcaacggcaggatgtcagtgtaaaagatgcagcagaagccaatgaaaagaaagattcaaaagatggtacagatacgaaagagcagacgtctatagtacgaaagaatatagatgagacagattctgaaaaagtatcgtttggacagaggataacaagtaaatttcacgatatcactaataaaatcaaaggtattcgtggaaaactggcagacctgtccgggcaggcaggaaaaataaaggctgcactgaccgatgaacataaccgtaatagtgtttctgcaatctggaaagaacttaaatatttactgaaacattcgcgttttcgaaagattgacacagaactgaattttgcactgtgggagccgtcagcgaccggacaggcacttggaatccttgccatgtttccggcaatctatcagtatgatattgggatttatcccgattttgaagcagataagacatatgtgaaaggtacttttctggtaaaggggcacatccgtctcgtacatgtacttatatccggtatccgtctgttaaaggagcgtgatatccggaattttataaagaaattttttaagtaaagaaaaagagaaaggcaggtttttattatggcagacaacagttttcatacaacagtagagtccttgtttaaggggatggacagttttatcacaacaaaaacagtagtgggtgatgcgatccatattggtgatacgatcatccttccgctggtggatgtttcatttggcgttgcagccggagctttttcacaggaaaagaaaaataacggtgccggtggtatgggtggaaagatcatgccgagtgcagttcttgtgatccagaacgggacaacaaaactggtaaatatcaagaatcaggatggaatcacgaaaatccttgatatggtgccggattttgtaaacaaatttacctcgaaaaatgatgtggtttctgaggactccgcagcggatcagaccgatgatgccgcaaaatcagcagctggaaaagagatggaggatatcttaaaggattccgcaaacaaataattttttaaaacagtatagaaacgcaaaagaaacgcatatattatcagtaatatatgcgtttctttattggagtctgccatgaaacggatgctcggatttgcactgttctgcttcgcaatgggaatgcttgtgatgatcgtcattcacaaccgtttctgtgggtttgtgctcatgattttatgtatgctcgcaggttattacctgttctgctgtgatgactgttagccgatcagctcttttacacaggcagcgattgtttcatctttacagtttgcaaagaagtactcgctgaaatgttcgccgcttaaagcaccgactacaaggtcacggtcaagttcttttaaaatagatacaagatcacgatgagttatttttttaacctcgtctaagatttttttattgcgctgttccggtatgacacgttcctttggatatccgccgccacccggagcacagaacagtttttcaaagatataggtaagatttaattctccaccccagccaaaattctcggcgaatgggagagcaatgcagtttccgtcattgacctgtgagaacagataagcgtcaagaggggattcaatgtgtccgcagagtacctgtgggaaagcgttgcatgcaagcatagcgccctcgccggttccgcagcctgtgatgacaaaatcagcggcaccggagtttaataaaactgctgcaagaataccattctgcacataagtaagctggtgtgtatcttctgcagaatacatgccgtagttgaatacctcatgtcccattggttctacgacagattttaaagtagcacagatcatttcattttttgctgcctggctgttttcgttgattaatgcaattttcatgaatatcctcatttctgtactgccggtatattgttttgccggaatactggcagtacgtccgtattccggcattatatctggttcttaaaaatgtatatctgtaaatatacgataggttattacattaaatctttcattgcaacatcatccatatcatcaaagtcctgattttcgccaaccattccccagatgaaagtgtatgcctgtgtaccgcatccagagtgaatggaccagcttggagagataacagcctgttcgttgcgcataacgatgtgtcttgtctcggtcggttcacccatgtaatgcattacaagtgcatcttttggcatatcaaagtacagataaacttccatacgtctgtcatgtgtgtggcatggcattgtgttccatacgctgcccggttcaagttttgtcatacccatttcaagctgacagctttctacctgtcccggaagaatatatttgcagatcgttctgtggttggctgtctctaaagaaccgagctcaactttgttacagtcctttacaatgacaacaccgtcttccggtgtaccctccggtttgatcagtacggtaggataagtcatatgggcaggagcgctgtttaagtaaaattttgcaggggaatctgcgttttcactggcaaaagaaatatcctttgaacccatgccgatatacatgccttctttatgggcaactttgtattcttttccatcgatcgtgatcacaccggcaccaccgatattgatcacaccgagctcacggcgttcgcagaaatactgtgcacgcagctcatcgccggcggttaattttaaagtttcttttaccggaacagcagatcctgtgatgatacggtcgatatggctgtatacaagtttgatgacttccggctgaaacaggtcgtcaattaaaaattcctctcttaaacgttcggttgtgtaatgtttgacatctcttggagatgctgcagtacgaagttccataaaaatcctttcctgcgcctttctgtgcgcatcacaaatatcttaatatatgaatccaaaacgctgaaaatcaggttattaaagctgcctgcatcctgttttatatcttagcaggtttttaagttaaatccaaagtaatttacagagttgttgtagcagataccttttacgatctcctctaatgtatcataatctgctgggaactcaccgttttctacccatccaccgatcaggttgcagaggattctgcggaagtaatcgtggcgtgtgtaggataagaagcttctggagtctgtcagcatgccgacaaaaccggagagatttccaaggtttgcaagggagatcatctgatcctgcataccggtcttgtgatcgttgaaccaccatgcggaaccctgctggatctttgcgacagcggtggaatcctggaagcatcctaagatcgtgccgattgcctggttgtcgttcgggtttaagctgtaaatgatagtttttggaagatttccgctcttatttaagaaatttaagaaatctgccatctcagaagatggtgcatagttgttgatgcagtcgtatccagtatccggtccaaggcggtcgaacatcggagtgttgttgtcacgtttgcatccatagtgaagctgcataacccagttacgttttgtatactctgtgccgacaaacagcataaatgcagtcttgaattttaactcttcctcacgggtaacaccttctccggagagacgttttgcaaaaatagcttcaatctcatcatcggaagccggtgcgtacattacatattccaaagcgtggtcagatacgctgcatcccatggaagcgaagaaatccatacggtttgaaagtgccttctttaaggctgcaaaggtatctactttgatgccggaaacgtcagataactgtgcaatgtaatctaaatatgtaactttttcgatattcattgccttgtcaggacgccatgccggaagaacctgaacgtcaaaagaatcatcctctgcaatctttttgtgccattctaaggagtcgaccggatcgtcggtggtgcagatcagagtaacgttggactgtctgatgatgttgcggacagacatatctttctctgcaagtctcttattgcataactcccagacttcctcggctgttttcttgtttaaaacgccgttgtaaccgaaatatttctttaactccagatggctccagtggaagagcgggttgccgatcgctttgccgagaacctcagcccattttaagaatttttccttgtcggaagcatcaccggtgatgtatttttcatcgacaccacaggaacgcataaagcgccatttgtaatggtcgccgcctaaccatacctgggtaatgttttcaaactgacgatcttcgtagatttcctgcggattgatgtggcagtgataatctaagatcggtgcatctgctgcgtaagaatggtaaagtttctgagcggtctcactctgaagtaagaaattttcgtccataaattgtttcattgttttttcctccataaaaatgttttaaaataaagtagttccacgtttgatcagtttgccggagaaaatagatttcttcggcatttcttcaccggaaagaacaccgactaaggtctgtactaactgatgggtctgtgtttctaagcggttgtccacggaagtgagttccggaatacagcaggttgtcagcatggagttgttgtacccaataatcgataaatcgtcgggcacagaaatatgattgcgttgtgcgtatttgactacgccgacggcgagtacgtcatccgcagcgatcactccatgaaaaggaggggcctcttttgcaacctgatccataaaatctgcaatttcattgaattgctgggaatctccgtcgtatttgtggatcctgttttctatatcagagatgccatgtttttttaaggcgtctttgaaaccatttaattttttgcggccactatatgaaatagaattgtaaatatagactggatcggcgataccggaatctaacatggactcggtagcctcaaacatagtcgtgtagtcgtcgcataaagtgctgtaaacgttcggataatcaaaggaagcgtttaacagcatgatcggtacctgcgtggaaacatctttaatatactggttttcatcctccgtagtaccgatgaaattagaaccgacaagaatgatgccgtctacttttttggaaaggatcaaattcaggtaattttgcttgagctccagattatatccggtacagcagagcagtgactcataaccgtttgcctgcagctcctgttccagataataaactgcctttgcgagaaaaagatccgaggaatctgcacagagaataccaatcgtctgcagggagtggagtcccatgccgcgtgcaaaagcatttggtgtgtagtcatatttttcaatgatatccatgacttttttctttgtggaagggcggaccttgtcactgccgtttaatacacgggatacggtagcaatcgatacacccgctttttttgaaatatcatatatagtcatataaaaaatccttttataacaaatttgcatcctgaaacgtttcggattacattaaatatagaatgtaaacaaaaatgaaagcagtttcattgctgctggtctgattatacaatattaaaaaaaataaagcaatatcggattttgtgaaaatagaaaaagtgtagaagaaaatatggtgattttaaagaaaaataacaaaaattactaaattgtgcaaaattacatattgacgaaacggcaaaaaggtgtaagaatacaaattgtaaacgcttacaaaatgacattgtgcagtgatgagctgataagcaggaggaatatgatggaattattaaacagaaagaaaacaggaaaagtggagagaccggttaaagtattacagttcggagagggaaatttccttcgtgcatttgttgactatatgatcgacattgcaaatgagcaggggaaatttaacggggacatcgtacttgtaaaaccgatcgaatttggaagtcttgacagattccatgatcaggagtgccagtataccgtacagttaagaggaatcgtagacggtgagccaaaacgtatcaaccgcattgtgaccagcgttgcagatgcagtagacgcttatggtgaatatcagaaatatgcagattatgcaaaacttgacagcttacgttacattgtttcgaacacaacagaagcaggtatcgtttatgatgatacagaccgattagagatggaaccgccaaaaagctatccgggcaaattaaccaaattcttatatgagagatataaacattttaacggggcaatggataaaggtcttgtgatgcttccggttgagctgatcgatgacaatggtatccacttaaaagagtgtgtagagaaacttgcagtactctggaatttagaagagggatttaagacatggttagatgaagcctgtgtatttacttctacattagttgaccgtattgtaaccggttacccaagagacgaggcagaggagctctgcaaagagttcggttatcaggacaatctgatcgtaacaggtgagccatttgctctctgggtgatcgagagcgcaaaagatatcagcaaagagttcccgcttccggatgcaggacttccggtgatctttacagacaaccagaagccatacaaacagagaaaagtccgtatcttaaacggtgcacatacttcctttgtactggcatcttatctctgtggcaatgatattgtgttagagtctatgcaggatgaactgattttcaactttatgaaagcaacgatctttgatgaggtcattcctacactgacacttccgaaacaggatttgattgattttgcagaggcagttatcacaagatttaacaacccatatgtaaaacatgcgttgttatctatttccctgaactctgtttcaaaatggcgcgcaagatgtatgccgagtttcttagagtacattaagaatgaaggaaaacttccaacacacctgacattctcactggctgcactgatggcattctacacaggaacagagatccgtgacaaggctctgatcggacatcgtgacggtgctgaataccagatcttagatgacgctgcggtattagagttctttgcagcaaacagttctaaggatgcagcagagtatacacatgctgttttatccaacgagcatttctggggcgaagattttaccaaattagccggagtagaagaggctgtaaccggttatatggaagatatccgtgcacttggtatgagagcagcaatggaaaaaacttttaacgcataagcaggagaacacttatgaaagattttataaaaatcaatgaaaatgataatgtcattgttgccataaaagaacttgcagagggagagaaagtcacagtcgatggaaaagaatacacagcggctgagacgatccctgccggacacaagatggcgatctgtgacatcccgcagggcggtgatgtgatcaaatatggtgtccgtatcggaaatgcaaaagagaatatcaaagccggtcagtgggtgcatgtacacaatatcaaaacagcactcggcgatctgctcacttatacctacgagcctgtaaaaacagaggagaaaaagacagaggagcgtacctttatgggatttgcacgtccggacggcagcgtcggtgtgcgtaacgaagtatggatcgtaccgaccgtcggctgtgtaaacaatattgcgacggcgatggcaaaacgtgccaacgcaaaggtacatggctctgtggaggaagtgattgcattcccgcatccatatggatgttcccagatgggtgatgatcaggaacacaccagaacgatcctcgctgatctcgtaaaacatccaaatgccggaggcgtgttagtacttggtcttggctgtgagaacagtaatatcggtgaactgaaaaaatacattggtgattatgacgagaaccgtgtgaagtttttaatctgtcaggaatgcgaagacgagatggaagagggcgaaaaactcctagaggaactgatcaattatgcggcaggattctcccgtgagccgatcagtgcatccaaactgatcatcggcatgaagtgtggcggcagtgacggattttccggaatcactgcaaacccgctggttggtaaattctctgatatcctgatcggaaagggcggaacaacgatcctgactgaggtgccggagatgtttggcgcagagacactgcttatgaaccgctgtgaaaatgaagaactatttgagcagacggtgaacctgatcaacgattttaaacagtattttaaagataatcaccagacaatctacgagaatccgtcacctggaaataaaaaaggcggtatctcaaccttagaggataagtctttaggatgtacacagaaatcaggaagtgctgcagtaaaaggcgttctttcctacggcgagcgcgtacatacgccgggattaaatcttctcagcgcaccgggcaatgaccttgttgctgcaactgcattagcagccagcggagcacacattgttctgtttacgaccggacgcgggacaccgtttgcttccccggttccgaccgttaagatttccagcaacagtacacttgccggaaagaaaaagaactggatcgatttcaatgcgggcgttcttgtggaggatgcagagttagaggagacaggtcagaaattatttgactatgtgatcgacgttgcatctggtaagaaggtacgcagtgaggaagccggattccatgatatggcgatctttaagcagggtgttaccttgtaaggaaacggaaaaaagttgtcaatctgatatgatggatatctacaatagaatgtttgtgcagaattcaatctgttatttcagaaacatccggcagaaaaagtagaaactggattcttattgaaagaatcttaaacataacacaaaaaaggagacagaattatgtcatttttaaacaatttctcattagagggtaaaattgcattagtaacaggcgcatcttatggtatcggatttgctatcgcatctgcttatgcagaggcaggcgcaaccatcgtattcaacgatatcaaacaggagctggttgacaagggattagcagcttatgctgaaaaagggatcaaagctcatggttatgtctgcgacgttaccaacgaggagcaggtgaatgaacttgtgaaaaaagtagaggaggaagttggtgtaatcgatatccttgtaaacaatgcaggtatcatcaaacgtattccaatgtgcgatatgtcagcagcagagttcagacaggtaattgatgttgacttaaatgcaccgttcatcgtatcaaaagcagtgatcccgtccatgatcaaaaaaggccacggaaagatcatcaacatctgctctatgatgagtgagcttggtcgtgagaccgtttctgcttacgctgcagcaaaaggtggtttaaaaatgttaacaaagaacattgcatctgagtacggtgaattcaatatccagtgtaacggtatcggacctggttatattgcaacacctcagacagcacctcttcgtgagatccagccagacggttccagacatccgtttgaccagttcatcatcgcaaagactccggctgcaagatggggaaatgcagaagacttacagggaccggctgtgttccttgcatcggatgcatctaactttgtaaatggtcatgtgctgtatgtagatggtggtattttagcttatattggtaagcagccacagtaaaaacagatgagatttgttgtgaattgaatcattgtcacaattgatgccaatgtcagctttgggtgggaagtggctgagccttgggacgtgcaccggaaccggcagattttgttgggttccgttgtacggaaataagaggttctaagtgcccctggtctgagtttgtggcagagtgacgcgtgcatccccggacgagccttccatggctcgacggggatttttgctgccatccgtggcagcaaaacgctgtagagggcagtacaaaccccggtcaaaccatggaaggtttgttcggggtgttcgcgtctggctccaaacatctccgcagggcaacttagaacctcttatcctcgtacaacggaaccaaccagctccgccccgccacaatcaccgcaggttttgccattttccaacaggcatccacatctcatatcgtaagtttcgccactttccaacaggcatccacatcccaatcaccatgcagggctagcaagccattccaacaagatgcccctgaaactccccaaacaaactttcctcctgcttcctcataaacaccgttacatccgcatctccaaacaccacctcaaaatgcacactccccacaaacgcatcgatcacatgcgcccgcacatacagagtgttctctgaaacccacactccgctggcagcatacctctggtcatagacgggaaactgtccgcagacaagttttccaaaaccgaaatgaatggaacacggtctgccgtgcagtgtaaacgtaaaacatccctcatcatttgtaaaatccgctgtaaaatctgtaaactcactactgtttggtttgaacatatatcgtttccccgaaacttgtgaagtgaccgctgccgtcattgcactatcgcccagaggtgcaatcgcaagtgaagagagcacagaaagaagctctgtatgcgttttttgatcttccgggagtggatctgcctgtatgaaaggaagaatctcatcatacagagcatcataaatcagttgatttccacccgcaagtccctgtgtgtctgcggtagtgacaaagagaagatcataatccggaaggtaatggatgaactgaccacccatgccgtagcagacaaaaccatttttttcactgcgccagatctgataaccatagccgcaggcttcacttggaagaggtgccgtgatgcgtgtgtcagagagatgggaggttgctgttttgatgtaggaggcagaaacgagctgtgttccatcaatatttccatcgtgagatagaagataaccgaattttaacaggtcggatggaagagcgacaagtccgcttccgcccatggagacgccaaaaggatctgtcagcatgtaggattcaccggaaaattccaaaacagacagcttttctttgagataatcgagcattggcatgccggaaagacgttctacaagcgcacagagtgtatgtgcggaggacgtatcataatgaaagagctttccggcaggatgggttggcggcacggtaaagaaactctctacccagtcacttttcatatcgactttgtaggtcgtcgcggcatggcaggtgcgcatcatgagcatatcccggatcgtcatggctgcaatccacggatgtacatttgctggaatcttgtctggaaaatatgagacgatcggatcatccagtgataattttccttccgcttccaaaagaccgatcgcaatggatgtaaaacttttactgatcgaaaacatgcgatgcagcgtgtctttctgatagggtgcatagtagccctcggcaatgagtgtgtcatgccgcattaaaagaaaactgtgcattggaacctgttttttttgtaaacgatccagaaagtgaagaaggcatccggatgggatgccagcactttctggagaaccttttttgaaattcattgtaatatcctccatttcttattaagactgaacaccaaagctgcttggtgtaacgccatattttttcttaaatgcacgtcggaaagacgtctggttgttataaccaacttccaaagcgatttcattgatacaggactcgcctttttcaatcagatgtgccgcctctgtgagccgcagatcttccagatagacagagaagttcacattcatattttctttaaacatatgagaaaaataactttctgatatgtggaactcgtcggagatcttgcttaagcagagcgccggatttttgtaattttcacggatataagtcacaatgctgtcaatcagattattcttttcggattttgatgcaaagaaatcacacagtttaatgctgatatcttcacagagacggaaagttaactcgtcctgtgaaagcatagtatcaatttccgctatctgcggagtactttctcccgtatatgtaaaacgtgctttcaacagagtgttgcggatatcggtaagtaaaaaccgtaataactgaaacggaagcgaacgttcttcaatgttctcctggtggatcagattgaaaatttcaatcacctgggatttatttccgccagtgatggaacgaatcagacgggttgaaaattcagccggatagtagtaaacatgggagtcttttttcaacatttcatatggaaggaaaatatagtttttactggtataccctgcagcatctttcgcctgttggtaagattcccatatgttggtgaaggagcaggagagaccgattcctgcaaaaaaccagatcgaatactcttctagcagttcactatgaaattttaatgctttttcctgaagtgtgatcagtatctcatcggcagttccactaaaagggattaacacagcataaatatgtttctttggggaacacagatataagttattttcataagaaaaatatctggccaaaagaccggcgataatatctttcatactttcagaactttcagtggaagtattttcatttggaaaagtatctgcagcaggatcattttcgtaagttacaccgtacaatacataataatgaagcgatggatcttctaaatgcagataattctggataaatgaaagctcatccggggttgtgataactccactcatcagctgtctcaaataattgtcatataaaacaggacggattgcagcagcttcttcgattaactgcgtatttgcatgcagtgtttcctggagctggtcatctaaatgaagaatcgggcgcatattgttgcggactaaaataaatatcatgataagtccaccgatgattgctgcaaaaaggatcagcagaaaaataaactgataatcggatggataaatggattccggctgtaccagatagaaagtccagtcatttgtttttgatgcgatccgcataatatgtgtgtcattgtgaacacaggtattattgtcatcataggataaggataatacggattcggtaagcgtatttaaatctttttcagatgatgtattcttatcttcggacagggaaaacactggctgatcctgtgcgtcgactgcaataatgtaaccggtatcacctaaagaaacaccgctgaaaattttgcgtaaggtctgctcattgatatggaaagcaacggtagcaggaatatctttgtaggtcagtacgtccatatttaacacataaagatatgcgttaccgctttcgggaagcataaaatccgaaagtggataaagggcagaatcttttgtcagattgttgttgagcagatcatgccattcattaaaatttgccccggaagataaatagtttcttatataataaagctgttcggaattgaaagtgtttacactgataatatagccgctatttctcagataaacaaaataggtactgaaaggaagctcattgtaggaatacatataagaggcaagggactgcttcatggtaagacctgacagataaaaatcattatcgtctgtggacttcatcgttgcaagacggtatagtttggtattcatgctgagctgtcttgtgatagaatccatggttgtgaaattattatctaaaagtgaaacggcactttcaaaggtagactgatcctgattccagaaatcctcttcagagcgtgttgttgagacacggtggaggtgtaccatcagaagtaaaatgataagtaaaaagacactgtatgtaatagcaaagcgaatcatgagaaacgtagtggattcattttttgctgtggcatccgctggtggattcaaatttattctcataggtattaaatgtccttttttcatgttttttaatcgtacgttctctattttatcataatatgaaaaaaatacaacaaaaactcaaaaacccagtaaaatcaatggtttgcgtagtgttaaaacaaattttgtaccccctgtcaaatattgtttcttgctgaaaatcccataagatggtaatgtatgagcaagacatgaaagcacttacatcagagcagtgtcgaaacaaattttttcctaataaggaggttcttatgaaaaagaaggtagtatcagtccttatggctgccgctatggtagctggtatggcaggatgcggttccagcaacactggtaacgcaggaacaacaaattcaaatgcttctacaaataatgaagcaaccacagagagcggtgatgcttccgcaagcacagcaacagattctgatgttgagaaaccggaagagatcaccattatggtagatggaactgttttcacacaggaaaacggacaggcagagttcattgctaaattggaagatcttcttggaatgaagatcaatgtgatccagccggatcatgatgcttactatgatgtagtaggacagacagttgcaagtggtgactggccagacgttatgatcttatcttctacctattatgcaggttatgcagagcagggagttctgtgggatatgacagacgcttatgcatcttctgatttaaaaacaagacaggatgcatacggcagcacaggagttatcgatggtgtaagacttgatggtaagttatacggtatgccggcagctcgtggtaacggatgtgttacatatgttaagaaagcatggttagacaactgcggacttgatgttccgacaaactatgatgagtatcttgcaatgctcgaagcatttacaaccggtgacccggatggaaatggtgtaaacggagatacctacggtgtatctgctgctggtttcatcggaacagaggctccatatacaaactacttaccagagttctatcaggatgcaaacccaagcttctataaagcagaagacggaacatggaaagatggattcacagaggattctatgaagagcgcacttgagagaatggcagctgcttacaaagagggcgtgattgatcctaccacattaacaaatggtacatctgactgccgtaacaaattctatgatgacagctttggtgtatttacttactgggcaggtacatgggcaaccaacttaaagacaaaccttgaagcaaacggtaaagacggtgagttagtagcattacctccgatcgctgaagtaggtcagtaccttgaccgtgttccaccagtatggtgcatcacatctgcatgcgagaacccggaaggcgtattcaaatatttcatcgagccgatgcaggatggcggagacgttcagttcttatggacatacggtgtagaaggcattcactggtcaacagcagcagagacattatttgctggaacagagaacgagaaaacatatgctgatggtgagttccatatgttagagaaccgtgagaaagagggtacacagtacaccaaagctcacatcgatccaatgcttgctttagttgagcttgcaaacgatcctcaggaagaatctgtagcagcagaagcaaaagagtctgcacagttattcaatgataactgcaaagctgctgatcttgttcctaccacagatgagatgagcgagtacaatggtgatttaacaacattaaagaacgagctgatcgcaaaagttgttatgggcgagatcactgttgatgatgcatatgcacagtttgagtcaaatcacggtgcagagtggtcacaggcaatcgttgattctttaaacaaataataaaactttccggtaaacggaactaagaactatgattggtgtcctggctgcggatatccgcagccggcacagatcatggatcacaaattcatgtttgattgaaaaggaagaacagatatgagaaaaagtaatgaaaaatcagccgtaacggctacaaccggtggaaagaagaaccacctggcagcaaaaatctataaatacagaggattctatctgatgtttcttcctgtattaatttttgcattaatattcttttatttgccaatgcttggaatccgttttgcatttaccgattataacggaatcaaagaggcaagttttgttggtctcaaaaattttcagaaaatgttttccatgccaaatttctggacggcattctggaataccttacagattagtattatcaaattgtttttgacaacagcagctgctgttattgtttctatctttttaaatgagattgcaaacattcattttaaaaagatcgtgcagacaattatttatctgccacactttatgtcatgggtagttaccgcatccgtctttactttgatcctggcaccgacagcagaaggtcttgtaaatacattcctgatcaacgctggtgtacttgattccggaatttatttcctgggggattcaaaatggtggagacttgcgtactatatcattaatatttggaaagaaaccggttggcagaccgttatctttatggcaacgcttgccggaataaatacagagctttatgaagctgcagcaatggatggtgcaggacgctggggcaagatgagatatattactttcccggctttacagaatacaatccttactgttttgatcttaaaccttgcaaaggttatgaacctgttcgagtccgcatttgtaatgcagaatgatgctgttttaggtacagcaaacgtacttgaaacttatatttactatcagaccttcaacagtggtgcgattccaaattacggttatacgacagccgttggtctgttcaaatctctggttggttgtgtactggtactgttctgcaatcacttaagcaagaaagtacgtgatggacgcggaatcgtctaggaaggagcagcagatatgaaaagcaagaaaaaaatagaagttttcccgatcgtaaacgggttaatatttattatcttaagtttactgattatcatcccgatgtggaaagtattagttgactcattcgatttaaaaaccgcatatggtatgaaattatggccggaggaatttggccttgcaggatacatttccgtattcaaaaacccaacgctgtcccatccgttaatgatttctgtaatcacaacgattgcaggtacgatcatcgcattgatcttatctacatttggtgcatatgtactgatccagtgggatatgccgggacgtaacttatttgcaaacttattactttttaccatgatttttcagggtggtatgatccctacctacctcgtattaaaatcattacatttaaccaataccatctgggtcgttatcttattcccggcactgaacgtgtataacctggtattgatgaggaacttcttcgaaggtattcctgccagcctgtttgagtcggcaacacttgacggatgtactccgatgcagacatttatccgtatcgtacttccgatgtcaaaagcagcattagcatccatcggtcttatgtttgccgttacatactggaacgactatacacattacaaactttatattacagattcaaacctttataacttccagatgaagttaagaagtatcatcatgggtagtgatcttccgcaggcaaacggtggtgcaactgagaacaccgtaaagaatgcagcaatcattgttatcatcattccattcatgatcgtatatccgttcttacagaaatactttgtaaaaggtgtaaatatcggagctgtaaaagaataaggaggaaggtttgtatggcgactattttctgggctggagattctaccgtacaatacaatgacattcttacatttccgcagaccggcataggacaggtgatgaacctgttcctaaagccggaggtgcgggtggagaaccatgccaaaaacggcagaagcacaaagagctttatcgatgagtcgagactgacaccgatttatgacaaaattaccgcaggagattttctatttatccagtttggacataacgatgagaaaaagaatgatccacagcggtatacagatccatattccgattacatggtgaatctggaaaaatttgtaaatgcagcaagaaacaaaggagcatggccggtttttattacgccgcttgagcgcagatgttttattgatgaggaacatttagatatcggggaacataccgattatgtggcggcaatgaaacagacagctgaaaatttaaatgttccgctgatcgatctttacagtatgagccgcgcagaaatgcgaaaggctggagctgaaaaaaccaaagaatggtatatgcatctgccggcaggtgtctatccgtcccatatggacgggctgaccgacaatacgcatctgaaatatatgggtgcagttgtctacgcgggatgtatagcgagaggtttaaaagaacttggcggtatctatagtgatttattagtggcttgggagtgatcccttgccatttttgtatcaggaaataaaaccagtgtttaggaggatttgagggttatgtcattgttatggaaatcagatcaggaagatgggacttataaaaacccgatactttttgcagattattccgatccggatgtgatacgcgtaggggatacctattatatgacggcatccagctttaactatgtgccgggactgccgatcttaacatccaaagatctggtaaactgggaactgaaaaattatgcgatcgaaaagatcgatgagccgggctatgatctgccgcagcatgcaaagggcgtatgggcacctgcgatccgttaccatgagggatatttttatatttactacggaatgccggatgagggcatctacatggtgcgcacaaaagacgcacttggaacctgggaaaaaccggtacttgtgttagccggaaaaggtctgatcgattcctgcccgttctgggatgaggatggaaatgcatatatcatccatggttatgcgaagagccgtattggatttaagagtcatcttggcatattcccgatgtcatgggatggaacaaaggcgacgggggaggaccatatcctctactgtggacttaagacacagccgacgattgagggaccaaaggtatataagcgaaacggatattattacatttttgctccggcaggcggtgtaaagaccggatggcaggtgattctgcgctcaaaaaacatttacggaccgtatgaggagaaaaatgtgcttcatcaggggaacagtatcgtaaacggaccgcaccagggagcactggtagatacggtaaacggcgatgaatggttccttcattttcaggatcgcggactttacggacgtattgtccatatgcagccggtcgtatgggaaaatgactggccggtcatggggatcaatgcagtggatggctgtggggaaccatgtatcatccataaaaaaccaaataccggaatcacagagaaaccttgttaccttgcggcgggagatgacttttcatcggaaaaactcggcttgcagtggcagtggattggcaatccgaaggatgatttttattctttgaaagagagaaaggggattttgagattatactgtaaaaatccatccgggaaagcggagccgatcctctgggagtgttcgaatgtgctgacggaaaaactggtctgcccatattttagagcgtctgtctgtgttgacatttcagcattgtctgaacaggagcaggcgggaatggtcatgatgggcggtcactatgcatatcttgcagtccgcatgatcagaggtcagaaacgtctgatccttggaaaatcttatgacggtgaggatggaatgcgcgagaaggcagagcagcttttggtactgccggaggaacaggaaaaagtttatctgatctttgcgatgcgcgagggagataacggcagtgtatttcattgttattattcattgactgatgatacagatagtgcatcctggacggaagtgagagcagagtttacaccgtctgatcatacctgggtaggtgcgaagatagggctgtttgcgaatgtcatcggggaaaaggaactgggaggctatggagatttcgagtatctgcatgtagaggcactggaagattagattatgggacttcaaaaagaattagaagcaaaaaatttagatggtgtgatccgtgaactgacagaaaatccatcctgcattgatgatgtgacggaaaaaggtgtaccgcttgctttgtatgcagcggaacttggagatttttctattgtaaagtatattgtcgaatattccagggcaagtatgaatacggtggatgaaaatcatagaaatattctgcattatgcagcggcgtccggtaatctggaaatgaaccgttaccttgtggaaaaagttggaatggatattacggcaggagatggtaaatgtgtgacgccgtatcagattgcatatgaaagaaaagatgagaaacttctttcttactataaagaacgaacaggtgcatcttatgaggggatgtatcataatccgatacgctgtggaatgttcccggacccgtctattgtgcgtgtcggggaagattattatatggtgaattcatcattcatatttttcccctgtatcccggtttcgcactcgagggatctgatacactgggaaatcatcggtcatgcgatcacagatccacagtgggcggcactggatgaactggaaggcggcagaggctactgggcaccggatatttcttatgataatggaaaattttatgtcacggcaacctaccgcctgaatgacacaggcactgtgtaccgtaaacagatcgtggtaagctcagatagaccggagggaccgtacagtaaaccggcggtcattgatgaggatggaattgatccgtctatctttcacgagaatggcagacactatatgctgctaaaccgtggggcgaggattttagaactgaatgatgactgcacaaagcagatctctgaggcaaaattgttatattacggagatcagaaacgtgcgccggaaggaccacatctgttaaaaaaagacggttattattatctgttcttggcagaaggaggaaccggaatgggacacaggatttctgttgcgagaagtaagacacttatgggaaattatgaaccgtgtccatacaacccgatcatgcggcagatggatgagggggcagcaatccagagatgtggtcatggaaagccggtctgcacacagaacggggagtggtatatggtatatctctgcggcaggatgatcggagatggttacagtatgcttggcagggagacggcgcttgatccgatcagctggacggcggatggctggccggtcgtaaacggtttaaagggaccttcggttctgcagaaaaaaccggatcttccggtgtggatgccggaagaagagccggatattggctggaacccaaaatggatgacaccacgtgcaccggagccggaaggaatccgttttctctcatcaggaatccgtatcaaagggagccgttttccactcagagatgtggctgctaaaaatattttattgcagagacagacttcgttttgttttactgcggaaacggaacttgtgataccgggacttacaggtggtcaggaagcaggtttagtctgttattatgacgaaaatacatgggtgtgtcttgcagtctgcagggaaaattcttattatatccaggtaaaagaacatattggggataaagatgttctgcatgagagacagatgcttccatgtgattgttcagggaaaaagatcagcctgaaagtggaaacagagtatttaaagcggcgttttacttaccggctgcagggggaagaaaaacatatagcagcagagattgcgaatgtttattatctatgcgatgaaggaattcatatgggtaagcgctttaccggggcaatgacaggtatttatgcggttgccggagaacacaaattgtatgcagatttttttaattttatttatcaggatatcgaagcataaaaaagtcagtatcagaaaaacgagggagacaaatggaaacaaaaagacaggaagatatcagaaaacttatgcagatgccggaagaggcgattgcttctctgaatgaatcagaggcagaccggctcggaagactagcagtcatgttttataaagaaacaggagatggagtatataaggagaaagcagaacagatccgtgcagcgcagggcgaattgccggaggatatctgtgccatgcctttttttatggaatatgaaacggtatgtgggaaaaaagagcggtacaataagatcgttgaccggatggaagatgaggcgtcagccggatttgccgatgcaaaagcaagaaatgcatatttagcagccctggtggatgtgattgatggaatcagttttgagatttatgaaaaataccgcactttgaccgcagtttataaacgcgtattaaaggatgcgttagctgagggagaagaaacaacggaacttgcctatgccatattaaagggctgcaatattggaattttgctgaaagaaaaatatgcagaaacaggtgctttaatggcagggcatctgaaaaatacgggcatgacagatcagacggaatatctgtcagacattacagcaagaacaatagaacaatatgatctgcttgcgatggaacagtcggaatagggaggaaaagagtcatggaagtaaaactgattatgaaatctgcccgcaatgcggtcattgaaattgcagatggtggaatttacaatacaaaagaaacatatcatgttctgctgaacggtgaagaggtattttcaacggatacggttataaattcattgtttgatttaaaaccgcagacttcctatgaggtttctgtaagaacagcagatggtaccgaactaggaacggtatcgtttgttacagcatatgaatttgtcacattaaatgtccgtgattttggtgctacaggcgatggaaaacaggatgatacgaagtttatacaggcagcgatcctagcctgtccgaaggaaagccgtgtgcttattccaaagggaagctatcgcattaccagtctgtttttaaaaagtaatctgcgccttgagcttgcaaagggagcagaacttatcgcagatacagacagggcggcctatccgaaatttcctggtatgattgaaagttatgatgaacagggtgaatataatttaggaacgtgggaaggaaatccattaccgatgtttgccggcatcatcaccggactggatgtagaaaatgtattgatctacggaagaggaacgataaatggcaatgcttcaaaagaaaactggtggaaaaatccgaaagtcatggtaggagcattccgcccgcgtctgtttttcttaagccattgtcagaatgtgacactttgtggtgtaactttcaagaacagtccgtcctggacactgcatccgtatttttcagataacctgaaattctacggacttacgatcaacaatccaagcgattcgccaaatacggatggcctggatcctgaatcatgcaaaaatgtagatattgtcggtgtgaaattctcacttggagatgactgcatagcagttaagtctggtaagatctatatgggaaagaaatataggacaccttctgaaaatatccatatcagacaatgcctgatggaaaatggtcatggtgcagtaacagtcggaagtgagatggctggcggtgtcaaaaatctggtcgtggaagaatgccggttttacgatacagaccggggactacgtatcaagacacgcagaggacggggaaaagatgccgttttagatcagattattttccggaaaatcgatatggatcaggttatgacgccgtttgtgataaactgtttttatttctgtgatccggacggcaagaccgagtttgtccagagccgtgaaaaaatgccggtagatgatggtacacctgcgatcttaagacttgattttgaagatattaaagcccaaaactgtcatgtggcagctgcatattttgatggactgccggaacagaaaattgagcagatcattatgaaaaatattacagtgacatatgctaagaatccgaaatccggcgttcctgccatgtcttccggtgtggaagagtgtacaaagaagggaatctttgcgcgcaacatcaaagaactggtattagaaaacgtggaaatagagggacaggatggagaacttcttgttacagagggaattgaccatttcgtgcagtagaacagaaagaggaaaacatatgcagttaggaatacgtttacatgatatcaaaaaagcaccacttgaggagcgccttgcaatcgcaaaggagcaggggtttttgtgcggacatctggcactctcaaaagtaatcacggaatatccggtggatgatggggcactgactccggggtatgcaatgtacttgaaaaaaatatttgcaaaaaacgatcttgatattgccgtactgggatgttatttaaaccttgcaaatccagatgaaggacagcttgcaaagatcacacaccgttatctggcgcatattcggtttgcatcactgcttggcgtcggggtagtcggaacagagacaggtgctgtcaacgaggcatataagtttgaggaaaaaaatcactcggatgaggcgctggatatttttatacagaatgtgaaaccggtgatttcctatgcagaaaaaatgggcgttatttttgcaatcgagccggtgtggaaacatatcgtatgcaatccgaagagagcgcggaaagtgcttgatgagatcgcgtctccaaatcttcagatcatttttgatccggtcaatcttttggatatcagcaattatcagaacagggatgtgatcatagaagaagcgatagagctgcttggagatgatattgcaatggtccatatgaaagattttgtggtgcaggatgggaaactggtgtcagtcgctgcaggaacaggtgagatgaactatgagaagattattcgtttcattaaggagagaaagccgtatatacatgtgacgcttgaaaatacaacgccggagaatgcagtacagtctaaagaatatattcagggattgtatgattcgtgccggatttaaaagaagttttttagaaaaaatcaggctgggaagaaagtaggattgcattcctgtgatataagatgtaaaataaaattgataatataaaaaagaggagaataaaaatgttaagaaaacagacaaaaaagattttagttgttatgctgtttgcgctgacattagttcttgccggaagagttgatgcgaatgcacagactgctgcaccggcaggcgtgaaacaggtaaaagcgggcagcagttctgtaacagtgcagtggaacgctgttatgcagaatgatatctgctattattaccgcgtcagtgatgatgcaggctttaagagcaataccaccagaagcaaacgtaattataatgcatccgaaagttatatttccggtctttctgcgggaaagagttattatgtccagatcggaacatctacaacaaaatcatccagtgcaccggatgatactgcatggtcaaaagcgatcgaagttgtgacagttccggagcaggtggtatcgaattctgtaaaacagaccggagcaggcacgacatccatttcgctgagctggcaggctgcttccggggcaaactgttacaaactgacctgttatcagagtggaacgagcgaaaacaatgcatcagagattgtttccaaaaagaacagtgtcaagatcacaggattaaagaagaacagtcgttatcagggacatatttatgcaggaagaacaagcagtacaggttataccgcatatgcaacttccggtggttattattcaaattcagcagtgacacctactaagatcacaggtgtagagaacacggctttttatccggcatcaaatgctgcatattttgaatggaaaaaagcaaatgctgcaaatggttatgaatatattatttatgacaattccaaaaagaaaatttattcgggctcacgtacttcaagtgcctcattccgtgtttctacaaataaattaaaaaaagaacagttttaccagatcaaggtaagaggttacgttaacttaagcaataacaagaaagcatatggtgaatggtctgacgtactgtattttgcaaaggatccgtcttacaaactgtctgtaaagacttccaaaaaaaagattcagttaaactggaagaaagtgaaaggcgcatcaaattatacggtatatatttccgataaacagaactctggttacaaaaaggttggaacctataacagcaaaaagacaagtgcaactatcagaaaattcgggaaaaaggcattaaagagcggaaaaacttattatgtaagaattgacgcaagtaaaaatgtaaaggtaaataaaaaatcaaagactttcaagaatacgcaatattatacatggaaggttaaggtaaaataggaaaaaggaaaaatccaaaagactggaatgcagatccggtcttttggattttttgtttcagtggaaaatccagacacaaaaaaactgccatatcaaatcggatacgacagttttttcagtgttcaaaattaagctctttcaactttgccggatttcaaacaggaagcacatacatataatttcttaggtgttccgtttactttacagctcacacgcttgatgtttgatttccacattctatttgatcttctatgagaatggctgacattatttccgaaatgagcgccctttccacaaactgcacattttgccatagttttgcacctccttgtaattcactaagtctgcctgtactatcagactcacaacatgtttattctaacagattcatttttatattgcaagcaaattttaaaaaaaatattaaaaatagtaaacaggactaggaattttggtaaaaagcggttataatagacaataaactagcgttaatatggctttgaaaggagcaggaacgtatatgaatggacatatggatacccagttgggaagagtttcaatagacccggaagtgattgcaacctatgcaggctctgtagcagtggagtgttttggcattgtaggtatggctgctgtcaatatgaaagatggtctggtgaagttactgaaaaaagattatttgacacatggtattaatgtagcgattgacgaggataataagatcacgattgattttcatgtgatcgtatcctatggtgtcagcatcagtacggtttccgacaatttaatcgaaacggtaagatataaggtagaagagtttaccggactggaaatcaaaaaaattaatatttacgtcgaaggcgtgcgtgtaattgattaaggaggacatagaaggtggaaatcactacgataaatactgagcttgtggcgaagatgtttcttgccggagcaaagaatctggatgcaaagaaagaatggatcaatgagttgaacgtattcccggttccggatggtgataccggtacaaatatgtcaatgacgatcatgtcggcggcaagagaggtaagtgcgttggaaaaaccggagatgaaagcgctggcaaaagctatttcatccggttctttaagaggagcgagaggtaactctggtgttattctttcacagctgttccgtggttttaccaaggtgatcgcagaatatgatgagatcaatgtacagattttatcagattctttccagaaggccgttgagacagcttacaaggctgttatgaagccaaaagagggaacaatcttaaccgttgcaaaagggatgtctgaccgtgcgttagaactttgtgatgatacagaagatctggtatatttttgtgaagaggtcatcaaggaaggtgaccgtgtgttggatctgacaccggagatgctgcctgttttaaaacaggcaggtgttgtggattccggcgggcagggactgatgcaggtcatgaagggtgcaatggacgcactgctcggcaaagaggtagattataccattgagggcgctgaaacaatcaaaaaggcaccggagagcacaggaacatcctataatatcgaagcgcaggcaaatcaggagatcaaatttgcatattgtacacagttccttatcatgcttgacacaccgatcacactgcagcaggagaatgagtttaagtcttatttagagacgatcggtgattccatcgttgttgtcgcagatgatgagatcgtaaaggtacatgtacataccaacgatccaggacttgcaatgcagagaggacttacctatggttccctgacaacgatcatcattgaaaatatgaagttagagcgtgatgagaagatttccgccctgaaagaaaaagagatgcagtcagccggcattccggaggaaaaagaggaaaaaccggcagaacctccaaaagagatgggatttatttccgtcagcatcggtgagggaatcaacgagatctttaaaggtcttggtgtcgattacatcattgagggtggtcagaccatgaacccaagtaccgaggatatgttaaatgccattgaaaaagtaaatgcaaagacggtatttattttgccaaacaacaagaacattatccttgcggcaaatcaggcagcatcccttgtggaggataaaaagatcattgtcatcccgacaaagacgatcccacagggtattactgcgctgatcaattacattcctgacagtacaccggaagataacgagcagcgcatgagttctgaaatctccatggtaaagaccggtcaggttacctatgcagtccgtgatacggtgatcgatgacaaagagatcaaacaggatgactttatgggtatcggcgattccggtattctttccgtaggacagaatttagagccgacggttatggatatgatgaaacagttagtcgatgaagattctgcaatcgtcagcatttattacggtgaggacacgaaggaagaagacgccaatgcacttggtgagaagattggagaggcattcccggatgtcgagatcgaggttcactatggcggacagccgatctactattatgtgatttcagtagaataagaatggagtaaaaatggatcgcaattcccctttaagagaaattaaaggtgtcggcgccaaaacagaagaattatttcataagataggagtatacaccgtaggtgatatactccttcattatccccggacatatatacagtatccgcaggcaaaacatgtggatgaggtactcgacggggaacaggcggcggttcttggacggatcacaagaacaccggtagtgcggaaggtgcgcaccatgcagatcacagttacgacgatcagtgagatgggagcctccttagagctggtatggtaccggatgccttatatgaaaaataatttaaaagtcggcagcacttacattttttatggaaaagtcaataaaaagaatggaagacttgtcatggaacaggcagcaatgtttaccgaagaacagtatgcttccatggaacaggtgtttttgccggtatacacactgacaaatgggctttccaataaccttgtcacaaagacggtgcgtgcggcacttggagacgaacacttgtttatggattatctgccgcatgccatccgcgagaaatacggtctttgtgagtataattatgccatccgccagatccatttcccggaggatatggagacactcattactgcgagaaggcggcttgtgtttgacgaatttttcctttttattctaagcatgcagtatcagaaggaaaagcacgttaaagaaaaaaacgagtttgtttttgcggaagatgattttacagatgaactgatagagcagctgccttatgaacttaccaatgcacagaaaaaggcacttgcggatgtaaaacgcgatatgcgttccgagacggtcatgcagcgtctgatccagggtgatgtaggttccggtaaaacgatcgttgcgtttcttgcgatggcagataccgcccacaatggctaccagtctgcaatcatggcaccgacggaggtgcttgcaagacagcattatgagtcctatcagagcatgtgtgaacagtttggactccatattccgatcgtgcttctgacaggttccatgacggcaaaacagaaacgccgtgcatatgaggcactagaggtttattcgaatgctatgatcattgggacacatgcgctgattcaggagaaagcaatctatcagaatcttgcgctcgtgatcaccgatgaacagcatcgttttggagtgcgtcagcgggagacttttgccggaaaaggaacagaaccgcatgtgcttgtcatgagtgcaacaccgatcccgcgtactttggcaattattatttacggtgatctggatatttctgtgattgatgaagtcccggcaaaacggcttccaatcaaaaactgtgtggttgaccagagataccgccccaaggcatatgcttttatcgaacatgaaatacgggagggacatcaggcatatgtgatctgtccgttagtggaagagagtgaaaatatggaagcggaaaatgtcaccgattatgcaaaacgtctgtgggaagaactgccggaagacattgtgatcggcgttttacatgggcagatgaaagcagagcagaaaaataagatcatggatcagtttgtaaaaaatgagatccaggtacttgtttccacaacggttgtcgaggtcggggtcaatgtgccgaatgcgacggtcatgatgatcgagaatgcagaacggttcgggcttgcacagcttcaccagctaagaggacgtgtcggaagaggagatgcccagtcgtattgtattatggtcaatgcctcagacagcaaaaattccatgaagcggcttgatattttaaataaatccaacgatggatttaagattgcaagcgaagatttaaaactccgcggaccgggagatttctttggcatccgccagtccggtgagatgcagtttttactggcggatatctatcaggatgcgtctgtattacagcaggcatctgaggaggtgcaggatctgcttgcgacagacccggaactatgcgaggaagaaaatataaacctgcagcactatctggaaattttctttgaagatcagaagagcaggctcaatctttaaaaattgatttcatgatagatttcatttacatactgcctgtaaattggaaataataatacggttacaaaaacgggagctttcctatggaaagctcccgtttttgtgtgcccaaaggcatagatccttgcggatcatagatcttagtggctcgaagaaccgtcatttacagcaaaaattatttgtggcaaaattatttgcctgacatctgtctctcctgcgcctcgatcattttcttaaccatataaccgccgacagaaccgttctgtctggaagtaaggtcaccgttgtaaccgtcctttaaaggtacgccgatctcgcttgctacctcatatttgaaacggtctaatgcactttttgcttcaggaactgctgctctgttagatgaacgacttgccataatagtttcctcctttagtgtgtgatacatcttttgttttataagatatcatttgtatgatttgaacaaacgctgcgttaatcataggttccgcggcgtttgtactttgctgcggtgcttttgatcacgttttgttttgttcagtgatagtatgtgaaatattacagcagctaaacatgcattttttgtcaaaaaagcaagtaatatccgcaacaagtgatacataaactttaaattttcggtacagaatgaaaaggctgtttgcgacaaaatattttagtgaattataataaagtttgtaagcgcttacaaaaaatatttacaaactggattatataagctatgataagagtaaagtgatttgtgtgaatcagctcataatacaaggggacaaaacacacgggagaaggagaaaacagtatggataagattgaaaaatacatcgatgaacttttagaaaagagtacgccggatcgtccaatctggaacattgaaaagattttacaggggaaaaaatcaacctggaattacatcgatggatgtatgatcaaggcaattttagagatgtatgccatcacaaaagatgaaaaatatttttcatttgcggatcattttattgactgcaaggtcatggaggatggttcgatcgaaggatattcggtggaagaattaaatattgacaatgtaaacgcaggtaagacgttgtttgaactttatgacctgacaggaaaagagaaataccgcaaggcaatcgatcttgtttacagtcagatccagaaaatgcctcgtacaaaagaaggaaatttctggcataaaaatatttatccgaatcaggtctggttagacggcctttatatgtgccagccgttttacatggaatatgagacgcgttttcatgacaaaaaaaaatatgacgatattttttcacagttttttaatgtggtaaagaatatgcgcgatccaaaaacaggactttattatcacgcatatgattcctcaagagaaatgttctggtgtgacaaggtaaccggtctcagccagaatttctggctccgcgcattaggatggtattccatggctttgctcgacacgttggacaaagcggatgcatctgtcggggaaccatatgagaaaatgaaacagatttttgtggagctgatggactctatgttaaaatatcaggatgagagcggtatgtggtatcaggttgtaaatgtcggcggcatggatcgcaattatcttgagacaagcggaagctcgatcatggcatatgcactgttaaaaggtgtgcgccttggattccttccggaaagttatcgtacctatggcgagaaggcatttcacggtatttgtgagaagtacttatcggaagatgagaatggtgaacttcatttagacggaatctgtctggttgcaggactaggcggtgcgaacagacgttccggaacttttgattattatatgtccgaaccggtcgttaaggatgacgcaaagggcgttggtccgtttttacttgcttatacagagatgaaacgattggaaatgtaaaataaatcagaacatttgccggcaaaggaaaaaggagcagatatgagcagtagtaaacaaacaaaatttagtggaacaaaggcagcaggcataagtattcttgcactttgtcttctggcattttcgcagcttttggcacttctgatcggaaatatgctggtggcaggcggaatgtcagcggtgacaggaaatattttcactggaattttatatgtgggtctggtacttggaggagtctttctgatctgtaaaaaaatgttaaaaataccaatggcagattttaagatcgggaaaccggatctgtatccgttttggatcatcgccgcttttgcaatgccactgttggtgattctgatataccagttatttgcaggaacgtggcagcaatcaaccttagaagcagaaacattaaaacagcttgttgccggaagtgttgcatatttaggattggcaactggaatcgtggaagaaacggtattccgcggaattattatgagttcggtggaatatgcatggaaccggaaaattgcagtgatcgctccatctgtcctgtttggctgtctgcatattgaagaaggaatgagtattcccggaatgatccaggtagtgatagcaggaagtctcgttggaatcctgttttctctggtgacctgctataccggaacgatctggtattccgcactcatgcatggaatctggaattgtctgatgatcggaggactgattcatatcggatctgcggcagatagtgcggtctggtataattatgttcttgataccgattcttttctgttgacaggtggagatttcggtgtggaatcttctgttatttccatagcagcgtacctgatttttgcagtgatcgcatttttgttactgcagaaaaggaaagaagcgtaaattactcaatcattgtaagcgaaaaaaacgcagtcgtgaatcgtataaaaattcacggctgcgtttttttcatgataatggtttggttcgcgaaacgtgtattctattgcttacgatgatagtgttttgcatgcaggtcatggcgtattggattattgatttattccaccagtgtcagaccggagatatccgggtgtaccgtcagtgagaagttggtgtaatatatcacaaaacccggagcacttccgtttggctttttcacatttttcttctggagataatcgatctcgatcttgtcactgtctctgccgctggaataataaccggcaagttttcctgcctcctcaaacatacggtccggcagatctgtctcgttatttgttttcacaacgacgtgggagcccggcattcctttggcatggaaccaccagtcgtttccggttgcaaatttaaatgtcagttcttcattctgataattattttttccgacatacatatgatagccgtctgaggaaatataatggaacggtttacttttgatctttgcttttttgtcagtgcgtttccgcttaatgtagccatattccaccagttcttccttgatctgtaccagatcgtcctcggtcagggcgatatcaagagatgtggcaatgctctctaagtggtcgatctcagatttcgtttcttcaatcaggtcggtcagtgcctcgtaagtacgttttaattttccgtatttatcgaaatatttctgtgcatttgctttggcgtctaaggtcgggtcaagaggaatctttacgttttcgttcgtatagtaattaagcgcttccagttgttttgcaccttcctctaaatcgtaaccgtaggtgtggatcagttcaccgtatactttgtatttatcccttttttctgtatcttttaactgtttctgctggagctggtattttttacggttacgctctaacgcagtggacacaatttttcttaagtcgacagatttctggcggatgcgcgtgtaaatatttttggaagcatagtattcctccagaactttggaaatcgaatcgtattccgtcatggtataagcattcgtgtcagcatgatccgtgttctgcataattttttgatccagagcagtgtgcacatattcggacagacgaaaacaggaaaaatcgatcggttccctgccgcgtgtgatgatatttgggcagtaattgtgattttttacatcttccatcatccatgaaaagttatggaacaggtgtttcttgccgtctgcatcgagcgaatctaccggcatatctccgtcgatcgaagcacggtaacagatctcgtttgcaatcacagggctgatcccggtaaaagagccataaattgcctttgtgatggaaacaggttttttcatgacagattccatgaaaacttcctctgtaacttcaagcggatttaatttgtcctcctgcgtggctggaatgcagtaagcccgtcccggaaggacctcacgcacggaactcatcatggaggatacatgcttgatgctgtcaatgatcgtgccgtcggagctgcagaaaataatgttactgtgttttcccatcagttccacgatcagtgttttctgacacagatcacccatttcatcgaggtgctcgatatcaaaatgaatgatacgttccatgtgaggctggtaaatttttatgatccgcccgtttgcaatgtgcttgcgtaacagcatacaaaaatttggtgctgtcagcggacttggtttgtttgtttctgtcagatacagaaaaggcagcgaagcactcgctgacatggcaagacggaactgcccgttacttccttttaaggtaaaaagaagctcgtcgttttccggttgggcaattttgctgatctttgcatttaaaattgtttgattcagttcatatacaagattggatattactaatccatcaaaagccatttttagatctcctttcggaatgtgtttccacggatttcccgcagaatgatattataacggatttttagcataaaaacaacgctgttggaatgtttatttgttgacacattatgatgaaacatatataaatattgcataaattcatttgaatacaataacttgtcaaaaaggtcagaaaacagatgaaataatcaaaaataacgatgattttgataatttacatgtctggatagtaattattttcattggcagatattgtatttgaagatgaggtgcagtgcgtgaaattgagagaatgagaaatggaggatttgcgtatggtaaaacagaaaaaaagtattgtgttaatggcaagagtgctggtgttagcattgctgatcggtgtatttgcatctgttccgtcagagcagacatttgcagccgcaaataaggctcttcgttcaaaagttgtattcaatggagataaagaatctgatgcagcgtggatgaataacaattatgttatgcaggcaggttacaaaaaagcttcaaaaataaagaaaaatatgaaaatgtctgcaaaagcgtatgttccggcagcagccttaaaaaagaatggagataccgtacatgtggatgcgtggataggtctggaaaatagtaaaaacggtaattatgttggggatatccgtacaaaatatacggtaatgctgatcaaagatggcaaaaaaatgcgtgttgcactgtgggatccggcgaaggaaaaagagtgtaaacctgggaaaacagccagctataaaaaatctggaaaatattatgtgatcacgatcaatgatatgccgctggaaaatgttgtttataaggatgaacagacatcgaaaattaacacaaaaacgaaatataacctggggcagggaatcggtgtcacaggcacctgctcaaagaccagcggatatgtatatgtggatgatttaaagatttcaggagtgactacgcagaagattacatttaataaaaaagactataaatggtacagtggatggcatttggataaaaattattctttaaaggttataactattaaataataacctgtctgtaaagaaataaaagtatggtaaaaatgggagctcgaatcgaacttccatttttatattaaaaataaattacaaatataaaaataaaattaaataaatgaaaagggctttttttataaaaaaaatttgctatactaaattcgtatatgaaagattaagacatcaatacaatcttggtattctatatgtcggttttataggtaaagacggcatatctgaaacaatcttttttattcattacagatacttttaagaatattccatggtaatgaaagtgaaaactgtgcttttatctgcattatacaagaactgtaccttgacaaataaataggaagatattcgatcagagaaagttgcttttccattacatgacgtttataataaggaaaaggaaaacagatatagtatactgatcaaggcagccgaaaggacggctttaccacttagatctgctccgagattcggagaaaggggtggtagcatggttacatatagtgacttgttcacatttgttattatgatatgtgccatcataacgcttgtcagaagtgtcagaaatgatacccatgataagacaaaaaaataaccgtccagctccccgctaaaggttggacggttacttcgtaacttaaacaatcacatatgccggagcagataggtatttgcttatcacccggctgtcttgataggtatattataaaagtttccatttcgtttgtcaacgtcgtaagtaaaagaatcaaaaataaaggataaaggagaatcagaagttatgagagagagaggaagaaagaacagaaccagtgccacaatgctggcaggatggaaaaaagcagtcgtattgatgcttgcacttatcgtgtgtatcagcagcatcgtagtaccacagccggaggaagtatcggcaaagcaggcagtatatctggattactatggcaaagataagcccaaaaatcaaatcgtgtttgcaacatcggatgatgccaaatggcataaagcaaatgaaggctgctgtaatgtttccaaaaacaatggaacatacaatcattatcactgcatgaaaaagaaaactgtttatgcaggagagaagttcacgattgttccggttgccatgtttaaaaatggagtggtggtaggatcaaaaaacagtaaagacggtatcaaatccggtgaactgaaatacaaatcctcgaacaccagcattgcaacagtaaatgcaaagggtgttgtgacagtaaagaaaaaaggaaaatgtaagatcactgtgacatccatctatgattcccaggtaaaaggaacattgagtctgactgtaagcaagggaaagcagaaagcaaagatcactttaaaagagaaaaaagcatccatcgttgtcggaaagacaaccactatcaaagtaaaatcctttaaagggatcagcaataagaacattgccttttcttccagtgacaaaaaagttgcgacggtatcatccaaaggaaaagtaaccggcaagaaagcaggaaaggcaacgatcaccgtaacttccctgatcaataagaatgtcaaagcaaagtttaccataaccgtgacaacggcagatatggcagatacagattattccgaaaaaggaaaaggtaagatcgtacttgcggaaaacagcgtaactttatatccggaaaaatctttccataagatttatgatcattgtggagatgctcacagccttgaatattataccgaagatcacgagagcatggatcagtttattggagaacagcttttagtacagaaagaaaagtacgggcaggcgcagatccgggtaaagagcattaccggagtaaaaagcagtgctgtttcctataagtccagtaatacaagcgtggcatccgtttcttccaccggttttgtgacaccgaaaaaggtaggaaccgcaacgatcacagttacatccaaagccaataagaaagtcaaagctgcttacaaggtaactgtcaagaaaaatgacatggtactggcagtgggatttgataggtacgataatatcaagtactatgtgaagaaaaatgaggatggaacgattgagtacagacgaatgcctgtaaaccgagaaatgttttcttctgataaaaaagttgcaacgtctagctcgcttgatataggatttattatgaccagtagtaatgaaaatgttttaaaggtagaggatgacgtttatcttgatgtgaagggaaaaggatcttctgttattactttaaaaacagtcgatggacgttggagttattcctggaaagtaaccgtaagcgataaaccgacttcctttagtaagtatgttacaggttgtagaacaggaaagggcatggatgaaactgatgaaaaggatggctgggtaaccaaactttaaaacagcaaggaaaattgaataagtatgaaaactatcaaaattaattttgatagtcagaaaagtgaactgcttggcatctgattaccttgcagttcattttttattattacggtattttcgaaatgaaaatataaattacacatgacaaaaaagtcgaaaggagatttatgagaaacaggataacacaattaagcagatttttactgctctgtgcagtaatgtttctggtcaccatgattccgcagagtgtgaaagcgatcacggtagaagaagcaggagaagcctatatgacggattcacaggcgggggcaggacaaccgctgtatggacggttgaatatcaactataccggaaatacgaactatgatacatggtctaacgatattgttacaaactataacacctatgacagtgaaaaagaccagtataaagccgctgaaacggtattgaaaaaagcagataactccgtgattggaaagaagatcaaaaataacagatctgcaaagcttacaaaatcgtcaggtggggatggaacagtacgggcagcatatttggtatggcaggcacgaacaagtgtagacagatcgaaaacagatgcagctgctttggcaaaatcagaaatcgcctttgtactgccggatggatcggcaaaactgataaaggcacagtatgcaacttatgataatcggtcgatcgattatatagatcaaaaaaaggaaaatggagtaaataaacagtacacttttgtcaatatgtatgcagatgtaacagacatcattaataaaagtgacaaaatctacggaacgtattcggtatttaacattccgtattatgaacatatcggtggcggtgagggcgccggaggatggcagctgatcgttgtggaaaactgtgatataacggttccgatgagagcagtacgtcttagaatgtctgcggattttaatattgatgatgtttcaaaacacgatggagaatgggtagagaaagatatcaagaccggaatgcttacaagtgtgagatcaaaggcatacaaggcaaatgataaagtgcctttgaccggacaatatctgatgatttttgtggagagcagtaacaagatgtcctcatttaaaaaaaataatctgtatgcacagaaaccgtctgaaaaatttgcaaaggataaattgattttaaaattggcaaagggaataactccatttttgtcaatcaatggatggcctttatacgataaagcaacgacaacaaagggagatttggttgattttacaattcccaaagagagtacacagcctgcctatgcaaatgataaatacacgctgcagaccaatacaggggatgaaacacactgggttaccatgtttgtaacgggtattgcggtagatatttcggataactttgcagagggaaatcaggtcacaacggtaaagagccctaccacagttaacgtttcacagaagatcaccaataaaaccctgcagacaaaaacaggttattacaatggaaaactggtagtcacattagataaagcactgactccgaccaatacgaaaccggaattgacagtatataataaagaagcggataaaacaaccacgatcacaggaacatggaatgcgaaaaatcatacggtaacctttgcggttgatacacagggagataagggaacattctatgaaaaaagtaaatttaaaaacccaagcagaggcagttatatcagttacagcatcgactgtacatatgagaaaaattccggagtggaagagtttaagaatggatctaggctgtccggtgatttgagatcacaaaatgttgcaactggtactaccattgatgacatattatcgaaagaatcgacaggaattccaatttatgtactcactgtcaaaatcgacaaaactgctacaaacaaagcggtaacggatgtatatataagagcaagcggtaaggctgctaaggcagttgaaaatataaaagcggctgctccagatgcaggaggtacagtaaacagtagcagcacggtatctggtgattattatatggcatcgtatgaggtgtcgtgcggtgcaacaattattacaacaccaaccttcaacaccggttaccagttcagcaaatggacggatctcaatgaaaagaccaacgcgtccaaagaccgcgatgtaacatcggacttggtaaatgataagacctatgcctatgaaagaagcatgccggcctgtaaccttacgctgacacttaccggtatcggggagccttatgaagtccgttattacataaacgcaccaagggcattgacgagtacggatgtgtggaaagtcggtaatacatttacactgatcggaaacagtgctaaagaaacagcaacaaagagttataccggaacacagatcagcagtatctgtaaaaataacacaccgtatatctataaaacataccgttacggcacctattataatgctgcattgtcaagcagtatcacgatcaacggataccgcaaagtgatcagtggaacccatacgaaagccggatggtggactgcagcaagcggcggaacctatgtaaatgtggacggtgcagcatccggagataatcagggcaagatctgtgccagtgactggcggggctatgcaaagagcggtaccttatccaatggaaaaaaaggaaagatcatttccctgtatgcacactgggaactggatcaggcagaatataccgtccgccactggaaacagaaagcagacggtattgcatcaacccatgacgataaaaactatgaacttgccgaaacagagacgaaaaaagcacagattggaagcaaggttactcctgcagtaaagacatacaccggttttgacagcccgaaaacacagacgaaagaggtaactgcagatggaaagatggtcattgattattattatgaaagacatctatataatgtaacattaaatgccggaaccggcattgaaaagacgaccggaggcggatcgtaccgctatggacagagcgtcaccatcgatgcggcagtaaaagaaggctatcactggttaaactggaaaggaaattataaaggcggatccggtggggagcagaccgtggatgctaaaaagtttgtatttacgatgccggccggaaacgttacaatgacagccaatgcagaggcaaataaatatacgatccattttgatccgaacggtggctttggacatatcgatgatattgaagcaacgtatgatgaagacgtaacgctgccggatgtatggaatgcagacggaacagcagcctatgtgaaatatacactggatggacaaaacgtgacagaggatgtgattgccggagtgattccaaaggcaatgatggatggatatgaagaggaagaaacggaagatatggaggataccgaagatccggataatgcggaagacccagagggtgccggtaattcagagaatgaggattccgaaaacaatggagatgattcggatgcaggtaattcagatgcagacgcacagaattccatgaatgctgtggaagaagcaggcaatgcagaaactgcagacaactctgatgaagcagacaatgcagaaatggcagacagttccgatgaagcagacgaggcagaaatggcagataattctgatgaatcagatgatacagacaatcctgatgtaacagacgatacggatcagaatgaaaaagttgccgtgacaaaagagaataaagatgatgtcgaagatattgatgctttcaatgacttagaggaagaagatatcgaagaaaataagaaagccgaggagccaaagaaaaaagtctacgcatccgtatttatgggctggtccttagaagatggcaaagacacctttatcccacagtggaaagccggagatatcgttcggaaccttgtggcagaagatggtggagagatcacactttatgctgcctgggacgactgcccgtggattcaggcacaggatctctattataccttagagcaggcacagagtggttttatcacggaagaagaaatcttaagccatgcaacggcaaccgaccgggaagatggaagtccgattttaccgggaaccaatccggcaccgagtgatccggaggttttcacatcctttacgatcccggactaccaggcagaagaatttacaaatttgcagcatgactttgccacatccgagaatttaaccgtggtagatcatgtgggaaacacttatgtgaaacagatcatggtgcatgtgaccgatacgacaccgaaaaaactcacacagatggatctgaccggagttacccgtttcatcaacagcaaatattataacaaatcgtttgaagaaggcggacttgaagataattctatctggaaagtcgatccggaatacaaggcagcactggaaagcgcattaaataacatggatcatgataccccggcggaaacctatgtattttcaaaggaaacgatcaaacagatgaaacaatatgtggaaactcacggaattggaaacagcaaagaaccggatgcgttgaataacttctataatcagttccttgcaccgaataggaaatagataataaaacatcaatatttccctttacaaattcttttgcagagcgtaaattagagagtgctggaatcatttcccggcagtaaaaatatggaggtttacaatggcaaaagaattgttaaaacgaagcgaagtaaaagaagaatatacatggaatttaaaagatatgtatgcgtccgacgaggattggaaaaaagatctggatgagattgacaagatcctggatgaaatcggaaagatggaaggtaaagtagctgcttgtgcgcaaaatctgttatttgtattagaacgcgcagctaaggcagaggaaaaactggattatgattttaattatgcagagcgtctgtttgatgaagaccagaaaaatacggcacatcaggcaatgtcccagaaaatgtattctatgctgacgaaggtgtcaagccagactgcatttatcgttccggagatccttgcaatggatgaggctgttctggaaggatactataaagaacttccagagttagaactttaccgtaaacagatcgaggaaatcgagcgtaccaaggcacatacactttctgctgaaatggaaaaactggtagcgatgacaggcgatatggcggagacatccggacaggtatattccatcatcaacaacgctgattttgtattcccggagatcaaagatgaagagggagataccgtaagactgtcccatggtaatttcgttccgtttgaggagtcggcagaccgccgtgtgcgcaaggatgcatttgagggattttatggtgtgtacaaacagtatgcaaacacacttgctgcattatataatggtcaggtaaaacagcaggttttctatgcaaatgcgagacactatcattcaacactggaagccgcagtggatgctaacaatgtttctccgactgtttatcataatctgatcgatacgatcaataagaatatggataaaatgcaccgttatgtacgtctccgcaaaaaatgccttggcgtggacgaactgcatatgtacgacgtttacacaccaatgatcgcagatgccgcaaagaagatttcttttgaagaagcgaaagaaaccgtgttaaaggcattagcaccacttggggaagaatacgtcgcaaaggtaaaagagggatttgaaagccgctggatcgatgtttatgagaacgagggaaagagaagcggagcttattctgcaggggcttatggttcacatccatatgtgctgttaaatcataatgatacccttgataatatgtttacgctggcacatgaaatgggacatgcgatgcattcctattattcaaattccagtcagccatacatttactcccagtataagatctttgttgcagaggtggcatctacctgtaacgaagtgcttttaatggagtatttgctgaaaaatacaactgataaaaaggagcgtgcatatctgctcaaccattatcttgacagctttaagggaactgtttaccgtcagactatgtttgctgaatatgaaatgttaagcaataagatggtggaagagggagagagcctgaccgctgagacgttaaataaattatattatgacttaaactgcaaatattttggaccggatatggtatcagattctgagattgcctacgaatgggcaagaatccctcatttttactataatttctatgtatatcagtatgcaacgggattttcttcggcagttgcactggcacatggaatcttaaaagagggagcacctgcggtagaacgttataagaagtttttatccggtggctgttctgcctctccggttgagctgcttaagatcgccggtgtcaaccttgaaacaccaaagccaatccaggaggcactggatgtatttggggaagtgcttgatgaaatcgaggcattgcttgccgaataatgaataaccggtggaaaattgtggaatactatatctatacaagaacaaaacaggaggattttgttttgaaacaggtagaagtattgatcgatgcaccggaaaaagcaaagaagctgtgtcatattctgagtggtcataaaggagcgtttgaccttgcaaaaggcagatatatcgtagacgggaaatccattattggagtctgtacgatggatctgtcgacccccctgacattgaccatacatgaggaagatgacacggtactggaggaaatccgcgaatttgtagtaaaagcaagataactcatttaccgaaaaacgtagaatcgcaaataactgaaagaaaaagacagtaacgatcgaaattgggttgttactgtcttttttgttttgtgcctgtggcagtttttctgttaaagataacatcgtatttctttggcgagattttcctcaagatggatcagttctttgcaaaatccctgggcctgtttgtccgcggccgcatactgattataatagcggcagagtgatttgacacccatattgcagccttcggtcaaaagatcagcacacacagcatcactttcctcaactgctaacttggcatttgttttcagccaggacattccctttgcaagcgcattcggttctttgaccggatcatcacatttttctaactgtgcatggatctcatttccaagacgctcgtgtttttctttggatgccatgatgacatttttgaaatctgcatccgaaattttatcacagatctcatccatggaataaacagccatttttgtgccggcattacattcccgcaataattttacagtatctccgtttaacatatagaatccctctttttcatgatttttatattcgcaatagatagaatgcggaacatgcattctgttgtttaatatgtcttgaaacagaatgaattatgtattgtttcagaagtacaaaacatttctttgaaaaataaaagcagaaaactttacatgattttaaacatgtgtcttgtcatatgtaatgataagtggtatactacgaaaagtttcattaaaaatctgaaatgaatgggcaaaaaatttgagagagagttaagagggcgtatgataagtttggaagaattagaagagtggaaaaagaaaagagatgccgtgatcctggcacattattatgtaagaccggaagtccaggcacttgccgattacatcggagattcttatttcctgagtaaaaaggcaacagagcttgcaaataagacgatcgtactctgtggcgtgacatttatgggcgagagtgcaaaattgttaaatccggataaaacagtactgatgccggatcttgctgcggactgcccgatggcacatatggtaacaaaagaaaccgtacaggccgcgagagaccagtacgatgaccttgcggtcgtgtgttatatcaactcgacacaggagatcaaatcgtggtcggatgtctgtgtaacttctgcaaatgcggtaaagattgtaaaaaatctgccgaataaacatattttatttatcccggaccggaatctggcacattttgtcgccgcagcggtgccggaaaaagaattcatttacaatgaaggattttgtattgtacatgaatttatgcaggtagaggaattgcttgatttaaaggcagagcatccggatgcaaaagtactggttcacccggaatgcaatcataaaattattgaaatcgcagattttatcggatcgacaagcggaattatcaattttgccggggagagcagcgacaaagaatttatcattggcacggagtgcggtgttcttacaaaattaaaagagcgcagaccggatgcagagttttatttcccggaaacaacaccgacctgtgtgaatatgaaaaaaatcacgccggaaaaagtgcttcatgtgttaaaaacaggggaaaatgagatccatgcaaaaccggaaacggaaggcgctgcaaaaaatgcgctggcaagaatgttagaacttgccggaaaataaaagcaacatgtgttaaaacggaattcgaaacatttccgatggcggcacagaaatgaggtcaaatatgaaaaatctgtattatgatgtagtgattgcaggatgtggtgtggcaggactttatgcggctttgaatctgccggaagaaatgaatattctgatgctttcaaaaaaagatttggaaagctgtgactccatgctggcacagggaggaatctgtgtactgcgggatgaatctgattacgattcgtactttgaagataccatgcgggccggacattatgaaaatcgaaaggagagcgttgatattatgatacgttccagccgggatgtgatcaacgacctgttgaattttggtgtccgttttgcaaaaaatccggatggaagccttgcctataccagggagggagctcattcccggccgaggatctgcttccatgaggatattaccggaaaggagatcacaacgacactactatcacatgtaaaaaaatgttcgaatgtgaccatcttagagtatacgaccatgacagatattttggtggatgatggcaaatgcaccggtatggtcgcagaaacaaaagaaggtgaaacgctgcatattcatgcagacaatacaattatggcaaccggaggaatcgggggtctttatgagcattccaccaatttcccaatactgaccggtgatgcatgcaggatcgcaaaagaacacggtgtggaacttgaacatatggactatgtacagatccacccaacatgcctttacagcaaaaagcctggaaggagtttcctgatctcggaatcagcaaggggagaaggcgcagttcttctcaatcacaaaggagaacggtttgtcaatgaacttctgccgcgtgatgttgtgacaaaagcaatacaggaagaaatgaaaaaagaaggtgtggagtatgaatggatctcatttgcacatgttccaaaggaaatcattttgaagcattttccgcacatttatgaaaaatgtctcgaagaagggtatgatcttttaaaagaaccggcgcctatcgtgccggcacagcattattttatgggcggtgtccatgtgaaccgcgattctgcgacaacgatgccaaatctatatgcagtcggggagacgagctgcaacggagttcacggaaagaatcggcttgcaagcaacagcctgttagagagtcttgtttttgcaaaacgtgcagcagtaaaaatacaaaatgaagagaaaggaaatgaagatcatgaatttgaatccaattaccatgcagcttgttgctgataaatatatccgtcttgcattagaggaagatattcacagtgaggacgtatccaccaatgccgtgatgccggaatataaagccggtgaagtggaactgatctgtaaacaggacggcgtgatcgccggacttccggtatttgaacgtgtatttaccatgttagatgcgtccacaaaagtggagtgggcgaaaaatcaggatggcagggaagtaaaagacggtgatgctgtaaaaaaaggacagctccttgcgacggtaaaaggtgacgtgcgggttcttttatccggagagcgaacagctcttaattatctgcagcgtttaagtggtattgcaacatatacacatcaggttgcacggttattagagggcagcagcacaacattacttgatacaagaaagacaacaccatgcatgcgtattttcgagaaatatgccgtatgtgtgggaggcggacagaatcatcgttacaatttatcggacggtgttctgctcaaagataatcatattgatgcggcaggcggtgtaaaagaagctattcttgctgcaaaagcatatgctccgtttgtccgtaagatcgaggtagagacagaaaatcttgacatggtaaaagaagccgtggaagcaggtgcggatattatcatgctcgataacatgacaccggaacagatgtcggaggcaatccggctgatcgacggcagagcaaaaacagagtgctccggaaatatcacaaaagagaatatcaaaacgatcacagcactcggagtggattatgtttccagcggtgccctgacacattcagcaccgatcttagatatcagcctgaaacacttgaaagtaacagattcccttcagtaacgcttgtaaaaatagacagattcagctaaaataaatgcagagtcaaaaaggagaggatcgcaaatggaaaaagaaatgaccggagcagacagaagaaaagaaatcctgtctatgatacgtgatacagatacaccggtatccggcacggcaattggaaaaaaaaccggtgtcagcagacaggtcgtggtgcaggatattgcacttctccgcacacaggggtatccgattatttctactgcaagaggttatctgctggatgaaccaaaacaggcagtcaggatatttaaagtatgccataccaatgaacaggtggaggatgaactgactacgatcgttgatcttgggggatgtgtggtcaatgtcatggtcaatcaccgcgtttatgggaaattagatgctccgctaaatatcaaaagcaggcgagatgtgcagaactttatggatgatttaaagacaggaaaatcgacaccacttctcaatgtgacgtccggatatcattttcataagatcagcgctgagagtgaagaagtgttagatgagatagaggaagcactcaaaaagaaaggctatcttgcggaattacttccatatgaacagtaagaaattaaaaaaaccgggatattgacttgaaatcaaattcgctttataataaaatcacttatgcatacgagaaagagatgaaaccgtgatgcataagtgatttttacgtgacaggatattttgcagaaacggagaaagatatgataaaaagtatgaccggttttggacggtgtgaatttgcggacgaaaaccgcaagtttacggtagagataaaagcggtaaatcaccgttatctcgatgtcaatatcaagatgctgaaaaagctgaacttcttcgagagtgcgatccgtacgctgttaaaagagtatatggagcgcggaaaggttgatatttttatcaactgcgaagattatacgcaggacaatgtttcattaaaatataatgaagcactcgcagcccagtatctgacttatctgaacagtatggcagagaagttcggacttgataatgatatccgtgtgagcacgctttcaaagtacccggacgtgtttacgatggaggaacagggcatagatgagaaatctctgtggcttggacttgaaaaagtgatccgcggtgcggcagagcagtttgtggagagcaggatcagggaaggcgagcatttaaagaaagatttatgcgagaaacttgatggcatgttatcctatgtggatttcattgaggagcgctcccctgtgatcattaaggagtacaaagaacggttagaggctaaggtggcagaactgctaggagaccgtcagatcgatgatgcaagaattgcgacggaggtaacgatctttgcagataagatctgtgttgatgaagagacagtcagactgcgcagccacattaagagtaccaaagataccttggaagctggtggcagtgtgggaagaaaacttgacttcattgcgcaggagatgaaccgtgaggcaaataccatcctttctaagacaaatgatcttgcaatttctgatatcggtatcagtttaaagacggatattgaaaaggtcagggaacagattcagaatatagaatagggacaggtggtatatggcaaagctaatgaatattggatttggcaatatggtcaataccgataagattgtctgtatcgtatcttcagactccgcaccggcaaagcgtatggtgcaaaaaggcaaagaacaggaaaatctgatcgatgcgacacagggacgcaggaccaaaagcgtcatttttacagaaaacaacaaaatcattttatcagcattgcagccggagacgcttgccggcagatttaatggcaatgccacagaggtatatgatgatacgaaagaatagaggaatccttaccgtggtatccggattttccggttcgggaaaaggaaccatcatgaaagaattaatgaaaaaatatgctgacagctatgcactttccatctcggctacgacgagaaatccaagaccgggtgaaacggatggtgtggaatattttttccgtacaaaagaacagtttgagcagatgataaaagacgatgcactgatcgaatatgcgcagttcgtcggcaattattatggcacgccgaaggcatatgtggaagaacagttagaggcaggaaaagatgtcatcttagagatcgagatccagggagcattaaaagtcaaagaaaaattcccggatacattgcttttgtttgtgacaccgccgagtgccaaagagttaaaaaaccgtctgataggcagaggaaccgagacgatggacgtgatcgagtcaagacttgcaagagccgttgaagaggcggagggaattgagtcctatgactatctggtagtcaatgacgtgttagaagactgtgtggaagaagttcatcagatcattcagaatgaacattaccgtgtaaaccgtaatgagtcagccatacaggaaatgcggaatgaactaaaaacattttcaaaatagtctgttcatgaaacagataaaaatctgtaacataaatataagaatctaagagcgggagaccgccatatgcgcaatgcgcaaagaaaggggaattatcatgatacatccatcttatgtagaattaatgaaagtagtaaacgacggtgtggaaattggtgaggagccggttgtaaacagccgttattccattgtgattgcagctgcaaaaagagcacgccagatcattgcaggagatgagccgatggcagagaaaaaagtgtgcccgaaaccattatccatcgcagtagaagaactttacgaaggaaaggtaaagattttaccggagacatcggatgaagaataatttaaaacttttatttgtatcacttggatgtgacaagaatctggtcgacacagagtttatgcttggcatgttaagagatgatggaatcgaaatgacagatgatgagcaggaagcagacattatcattgtcaatacctgctgctttatcaatgatgcaaaagaagaaagtatcaatacgattcttgagatggcagaactgaaaaaagaagccagattaaagtctctgatcgtgaccggatgccttgcacagcgttataaagaagaaatcgtaaaagaaatcccggaagtggatgcaattcttggaacgaattcctatgaggatattgtaaacgcagtgcatcagtccttagagggcaaacattatgagaatttcaagaccttagagggattgccgacactgcacaccaaacgttctgtgacaacaggcggacattttgcttatttaaagatcgcagagggatgcaacaagcgctgcacatactgcattattccgtatatccgcggaaattaccgcagtgttccgatggaagatctgatcgaacaggcaaaagaactggttgctgcaggagcaaaagaactcatcctggtggcacaggagaccacactctacggagttgatctctatggtgaaaagtcactgcaccgtttattagatgagttaaacaagatcaaagacctgttctggatccgtatcatgtactgttatccggaagaaatatacgaaggtctgattgatgccatgatccgcaatcagaaagtatgccattatctggatatcccgatccagcatgcaaatgataccatattaaaacgcatgggacgaagaacgagtaatgcagatcttgtaaagatcattacgcatctgcgtgaacgcattccggacattacactgcgtacgacgctgatctgtggtttcccgggtgaaacacaggaaatgcatgaggaactgatgcagtttatcaatgacatggaatttgaccgtcttggtgcttttacctattcaccggaggagggaacgcctgctgcagagtttaccgatcaggtggatgaaaatctgaaaaaagactggcaggcagatgtcatggaattacaggaagagattatttttgataaaaatgagaccatgaaaggcagagagttatacgttttcattgaagggaaagtgagtgatgaaaatgcttatgttggaagaacttaccgtgatgcaccggatgtagatggttatatttttattaatacagatgaagaactcatgacgggcgatatcgcgaaagtacgtgtgacaggcgcctatgagtatgacctgattggagaattgatctagcagtatttaaaatttattgtgcagaaatggagagtgtaaattatgaatttaccaaataaactgacggtaatgcgtatgatattgattccgttttttgttttctttatgcttgctccgtattttgaaggttatggcaattatattgcagtagctatttttatcattgcaagtcttaccgacatgctggatggaaaaattgcaagaaagtacaatctggttactgatttcggaaaatttatggatcctctggcagacaagctgcttgtatgctctgcaatgatctgtctgattgagaaaggacagcttgcagcctggattgtcatcattatcattgcgagagaatttatcatcagtggatttcgtctggtcgctgcagataatggaattgtaattgctgcaagttattggggaaaatttaaaacggttttccagatgcttatggtgatcgtgctgatcttaaatattccgaattcgttctttgcagtgcttggcacggttcttacatacattgctttggcgctgacagtcgtatcactgatcgattatattgccaaaaataaaaatgttttaaaagaacagaaataggagaatagcagttggctgaacatgtatatgattccagtgattcctgtaccggcaaaagtgcagtacaggaaccgctggaatattccatttatggtttgttaaaaaaatatcaaattacaattacaacagcggagtccgccacgggtgggatgatcgcgtccacgctgatcaatgttccgggaatctcagagttttttaaagaggggtatgtgacatattcaaatgaagcaaaagttaaaatgatacatgttgcaccggaaacaatcgatacctatggcgtggtaagcagtgaaacagcggcggatatggctgcttctgcagcaaaaacggctgcaacaatggcggcagtatccgtgacaggtgttgccggaccagatgggggaacgaaagaatgcccggtcgggctggtgtttatcggctgttatctgaatggaaagacagtgacggagcgtcatatgttttccggcagccgcatggatgtaagaaagagcgccacagaaagcgcactttccctgttaaaaaaatgtatagaagaaacgtatgcagtgtgaaaaatccatataggaaagatattttacactagaaaggcatggttattagtatgagaattattgcaggaacagcgagaagccttcctttaaaaacggtagaaggacttgacaccagacctaccacagaccgtatcaaagagacattgtttaatatcatacaggatgagatccctggatgctattttttggatctgtttgcaggaagcggacagatgggacttgaggcagtcagccgcggtgcgcagtatgccgtttttgtcgaaaataataaaaaagctgctgcatgcgtggaggacaatatccgctttaccaagtttacaaaagaaacaaaattatataattcggatgttttatcagctttaagagcgatggaaggaaaataccggtttgatatcatttttatggatcctccctataaacaggaacttgaatatgatgtactttcttacctgaaagattcttcgcttttaaaagaaaatggaatcatcatcgtcgaagcatcgttggatacagcgtttgactatttgccggatatgggattcacattgaaacgattaaagacgtataagacaaatgaacatgcatttatcatcaaaaatcaatagaaaaaatacatgatccatttgtatgggaggaacctatgaaaaaagcaatttatccgggaagttttgatccgttgacgttaggacatttagatattatagaacgatctgctagaattgtggatgagcttgtggtcggagtacttaataacagtgcaaaaaattcgttgttttctttagatgaacgtgttagtatgattaaggagatgacagattccatgccaaatgttacagtgacaagttttaatggtcttttagtcgattatatgagagaaatcgatgcaacgatcattgtaagaggactgcgcgctgtaacagattttgaatatgaacttcagattgcacagacaaatcatgtggaaaatccggaagtggagacaatttttttgacaaccagtctccagtattcttatttaagctctacaatcgtgaaagaatttgcatcttatggaggagatttatccaagtttgtgccggcacgttttatagaccggatatatgataagtatcagattaaaaaataaggagtggttactatggccagcagaattgaacagataatagacgagattgaagactatattgacggctgtaagacacaggcttttgcaccgtctaagatcattgtaaaccgcgaaactatggaagaactattaaatgaactccgcagcaagacaccggatgagattaaacgttatcagaagattatcagtaataaagaggcaatcttagcggatgcgcaggcgaaagcggatgcaatcattgcacaggcacaggtaaaaacagatgaacttgtcagtgagcatgaaattatgcagcaggcatatgcacaggcaaatgaagttgttatgatcgcaaccaaacaggctcaggaaatcttagacaatgcaacaaatgacgccaataatatccgtatgggtgccatgcagtatacagacgatattttgaaaaatttagagagtacaatttcacatgccatggattcttctaaggcaaggagtgatgcatatatgagtactctgcagggatttcttgatgttgttacaacgaaccgtgccgaattgaatcctacagcagacatacaggaagaaacgcagacggatacacaagagttacaacagaccatgccagaacagcagtaattagggtcataagcagtttaaagattccatattttttgatggaaagaccggttcctttgatcatcgaactggtctgtgccagaccggaacatccgccgaaggcagtaaaagtcatggcaagtaaataacggcaggcaggtgtaaggggtgactggctggcagctttgatcccgtttgtgatttctgtcaatccggtgagcatcagttttgtggtttctggcagtggaagcagccggaacatggaagatatcatggaaaacagcataatataacctccaagtctggttagtgtttcgaaaccgttcatgatgccggcgtctatgattttaaaatttatttgagatccagatgctggctttttgtatgtggtggagtggtttgatactgattgctttttctctgtaaagaaaaagagcagtctaccggcaatgagaggcggcaaaaatattaccagatagctgagtggtatcagggaaggcatatgaagttcctggcagagaatatagctgctgataaatacaggactgatgttgtttgtcaccataaacagtatttcggcttcctgatattctaactgcccgcattttagcatttcagcacagtttttgcttcccatcggaaagccgaacagaaaaccggacagcagcacaaaagagccatttctgctggctggtaagatcagacgtagaagcggatagagaagttttacaagatatccggtaaaaccagagtagatcaggatattggataaaatcgcatatggcagcagagagggaagcacccgctcataccagagaaccagcccgtcggctgctgcagttactgcgtcctgcgggaaaaataaaatataaacgataaaaataaggatacacaagaatattaatttctttttcatattagaatatatgagaaacaggaggcatctatgaagaacaaattaaatttaccagagttagaatccaaaaaagtatttgcatattttgaggagttggcagcgattccgcatggttcaagaaataccagacagatcagcgattacctgatttcttttgcaaaagaacatggtttagagtgctatcaggatgaggcaaacaatgttgtgatcattcaggaggcatctgccggatatgaaagtgcagacccgatcatcatgcagggacatatggatatggtctgtgagaaggaaaaaggcgtggagatcgattttgagaaagacggtctggagctttatgtagacggcgatttcttaaaagcaaaaggcacgactttaggcggtgatgatggtgttgcggttgcttatatcctcgcaattatggattcaccggagattgtgcatccaagacttgaggctgtgatcacggttgatgaggagatcggcatgctcggagcagaggtcatagatctttccatgttaaaaggccataagatgttaaatattgattccgatgtggaaggacatttcctgacaagttgtgctggcggtatgactgtggatactgtgatccctgtcatatggcagaaacagcagggatatggcgcaggactgactgtgactggcttagaggggggacactccggcagtgagatcgataaggaacatgccaatgccaatatcctgatgggacgtgtgttaaaatatctttccgaccgaatggaactggcggttgtatcacttgcaggcggcttaaaagataatgcaatcccgcgtgagtgtgaggcagagatcgtcattccggaagagaaaaaagcagaactttccgattatattacagaactggaaaagatttttaaaaaagagtatgctgtctcagatccggctgtctgcattgaaataaaagagaatggaacaggggagtatgatgtattatcttattcttccatgacaaaagtgatcttttatctgcgcaacgtgccaaacggcgtgcagcatatgagcatggtaatgcctggactggtagagacttctttaaataccggaatcatgaaactgacaacagatggcctggagctgacctcatctgtgcgaagcagtgtctccacaagaaaagaagaattaaaagataaattagagtatctggctgaatttttaggcggtgagatctctgtaagcggggattatccggcatgggagtatcgcgcggagtctgatatccgtgagggaatcagtgccgtatatgaagaattattccacgaggagccagtgtttgaggcaatccatgcaggacttgagtgcggtatcttatccggcaagatcgcagatctcgactgcgtttccttcggaccgaataactttgatatccatacaccgaaggagcgtctcagcatttcttctaccgaaaaagtatggaaactgattgtggaatttttaaagagaagtaaataaaaacgtttgtcataaatttaatattgcaaaaataagggagtacggactggtcttatgaaaaaagtcagattgtggctgcttgtgtttttatgtatgatggcagtgtttcaggtacttttgacagaagaacttttagagagtgcacacaggagaaactgtttttcttatgaaacggcatttcgcaatctgcggaaccataatctgacaaaagatcaggtcaataccttttttaacaatgccggatccgatatggaagggttttgtgagcttttgacgatgtattttgcatcggactgccagatgacagatcctaagctgttgaagaaacaggtcgcagatgcaaaaaaatatcgtggcaatgaatttacagagataaacggatatgtcaaaagcgtctggagtgaccttttgtgttttccggtgggaaagatcgcaggaaaaccggaagataacgttgtatttgaaaatagctggatgcagagccggacttttggcggcgaccgcggacatgagggaaccgatatcatggcatcggaaaatgtgcggggcatatatccggtctacagtatgaccgacggcgttgtggaaaatataggctggctccgtcttggcggctaccggatcggaatccggagtccgtccggtgcatatttttattatgcccatctggcggagtatgcaaaagactttcagatcggtgaaacagtatcggcgggcacatttctcggctttatgggtgacaccggttacagcgatgtggagggcacgaccgggaattttgcagtccatcttcatatgggaatctatctgaatgataaagatggaacagagttttcggtaaattcctatccgatgctttcttatttatgggaaagacaaggaggcgcacttaggtgaaccgccatttttcgacaacatcatttgcagcataatttgaatattatacagatatagtaaataatggcttttgatatagtaagattttagagaatggagagagcatgcggctggataaattactgaccgaactcggcacaggaagcagaagcgaagtaaaaaaatatatccgatcagggcttgtcacggtaaacggggaagttgtaaagaaaccggaacagaaagtggatgaaaaaaatgatacggtctgttttcgggggaatccgttaacatatacagagtatgaatattatctgtttcacaaaccggcgggatgtgtgactgcaacggaggacaatctgcaccggacagtcatggactatctgactgacacggcgcgccatgacctcttccctgtggggagacttgacattgatacagaaggactgctgctcatcacaaatgatggggcattagcacacgatctgctcagcccggcgaagcatgtttcgaaggtttactatgcaaaaatcgacggtcgtgtcacggaagaagatgttaacctttttgaaaatggggttgacataggagaagaaaagcctgcaaaaccggcacttttagaggttttgcattcgggtgacaattcggaaatcaggttaacaattacagaaggcaggttccatcaggtaaagcggatgtttgaggcagtgggaaagaaggttacttatctaaaacgtgtggagatgggatcactggtgttgccggatgaacttgctcccggggaataccgtccactgaccgaagaagaattacaggaactgcgccgacactgacaggcagacagaaaaaaagaaaacatgcagatgcagcttagatatctgtgctgtctctgtgcaatatacagaaatgaggatcaacatgaaaaatggttttttaccaatcagcaaagaagatatgagagaggctggtatagaccagcttgattttgtttatgtgtgcggtgacgcttatgtcgatcatccatcgtttggacatgccatcatatcgcgtttattagaagcacatggctataaagtcggtatcattgcacagccggactggcatgacaaagagtctattaatattttaggagaaccgcggctcggctttcttgtctctgcaggaaatatggattccatggtaaaccattattctgtttctaaaaagagacgccagagcgatgcgttcacaccgggaggcgtgatgggaaaacgccccgattatgcgacggttgtctattgcaacttgatccggcagacatataagcacaaaccgatcatcatcggcgggatcgaggcgagtttaagaaggcttgcgcattacgattactggtcgaataaattaaaacgttccatcctgttagactccggtgcagacatcatttcctatggtatgggcgaacacagtatcatagagatcgcagatgctctggatagcgggttagatatcaaagacatcacatttattgacggaacggtttacaagaccagaaaacgtgaggatatttacgatgcaatcgaattgccgcattatgaagcactgcttgcggataaaaaagaatatgcaaaaagcttttatgtgcagtacagcaatacggatccgttcgtagcaaaacgtttgtttgaaacgtatgatgggaaaatgtttgtggtacagaatccgccatcaaaacctctgacacagagtgagatggatcaggtatattcgcttccttacatgagaacttaccatccatcttatgaggaggcaggcggtgttccggcgatcgaggaggtcaaattttccttagtcagcaaccggggctgctacggcggctgcagtttctgtgcactgaccttccatcaggggcgtatcatccagaccagaagccatgaatcgattttagccgaggcaaaccagatcgtctgggaaccggattttaagggatatatccacgatgtcggaggtccgactgcaaacttccgtgcgccggcgtgtgacaagcagcttaccaaaggtgtctgtccgcataaacagtgtctgttcccgcagccttgtaaaaatttgaaagtagaccacaaagattatctgtcgctgctccggaaattaagacagctcccgaatgtgaaaaaagtttttatccgttccggtatccggtttgactacctgatttacgatgaagaccgcacgtttttacgtgaactttgcgagcaccatgtcagcggtcagctgaaagttgcaccggaacatatctccaatgcggtattggagaagatgggaaaaccgagcgtggaagtatataaaaagttcgtgaaggcatataaggacatgaacgaaaagcttggcaaaaaacagtacttagtgccatacctgatgtcctcccatccgggttctactttaaaggaagcagtagaattggctgaatttttgcgcgatcttggttacatgccggaacaggtacaggatttctatccgacaccttctacgatctcaacctgtatgtattataccggattggatccacgcacgatggaaccggtttatgtcgctgtcaatccacatgaaaaagcgatgcagagggcgctgatccagtaccggaacccgaaaaattatgatctggtggaggaagcactcacaaaggctggcagaacagacctgataggatttgacaaacactgcctgatccgtccgagaagagaacattcttttgatcgaaatggcgcgaaaaatgacagaggaaacaattcccacagaagcagttcaaaaaatgacagggacaatttccacagcaaaaacagcgtgaaaaatgacagacggacggtcacatccggcagccgtaaaaagattacagcgtctggaaataaccagcagaatactggcgctaagaaaaaaaagacgatccgcaacatccataaaaagaaatagaaagaaaattttatgcgtgaatttaaaatcaatgaaaacgaagcgggacaacgctttgataaatatttaaaaaagctgcttggcaatgcgccgggcagctttatatacaaaatgctccgaaaaaagaatattactttaaatggaaaaaaggcagacggaaccgaaaagttgaatcagggcgacgatataaaactgtttttttccgatgaaacctttgagaagttcagtggaagcggcacaccggattctgaattcgaggcacttaaagtactttcgagggagtttacatcaggaaaacggaaacttccggttgtttatgaagataaagatgtgatttttatcaataagccgaccggcatgctttcccagaaggcaaaaccggaagatatttccgcaaacgaatatattcttgcatatctgatcgcgaaaggggaactgacggaaagttctttccgtaccttccgcccatcgatctgcaaccggcttgaccgcaatacatccggtctgttagctgccggaaagaccttaaagggacttcaggagatggcaaaagccttaaaggaacgttcggttcagaaatattaccgctgtatcgtaaaggggacggtaaaagaagcttcttatctgaaaggttatctgcagaaagatgaatcgtccaatcaggttttgatccgcaggacaaaaccttctgagggagaatggctcccgatcgagacggaatataaaccgattcgctgtatgggcggttacacggagtttgaagttcatctgatgaccgggcgatcccatcagatccgtgcgcatcttgcgtctatcggacatccgatcataggagactataaatatggagattctggagttaatgtatattttaagaaaaatgcaaggataacgtcacagcttcttcatgcaagccgctttgtatttgaggacggcagggagattacggctccatgtggtgctgaatttgagcgggcatggaatgtgatcgaaaatttataaaccgatgaatgtacattctgtcatgtgcatgttttcagactatagtgttcgaaaaaatttggaataatttatttttataaaggagtaccatcatggcaacctggaactcaagaggactcaggggttcaaccttagaggagttcatcaaccgcaccaatgaaacttatctgacaaatggccttgcactgattcagaaagttccaacgccgatcacacccatcaatatagacaaggcaacaaggcatattacgctggcatattttgaacagaaaagtaccgtcgactatattggcgccgtccagggaatcccggtgtgttttgacgcaaaggaatgtgcgacagacacctttccgcttcagaatatccatgaacatcaggtaacattcatggaaaactttgaaaagcaggggggaatttcattttttctgatcagttttaccgcaaggaacgaattttattatctgcgccttgcaaagctgttggaattttggaaccgcgcaaaagaaggtggaagaaaaagtttccgttatgaggaattagaatccgattatttccttccgaaaggaaaagcggtactggttccttacttggatacgctgcaaaaagatttgctggcaagggattgacattccctttgttttccaatataataaacagcagttttatgtggtagcaaggtagcacactaaagtgtaagagaaaaatgtgtgcagggacggcagaaaaatcacttatcacataacgtcccggaatggagatttgatgaaaagacagttattacatacacctgaaggtgtcagggatatttacaatgacgaatgcgagaaaaagctgattttgcaggatgaattattaaaagtacagaaacagtacggttatcacccaatccagacaccaacatttgaattttttgatacctttggcagagagatcggaaccacaccttcgaaggatctgtataagttttttgaccgggagggaaatacgttggtacttcgaccggatattacaccttccattgcgcgatgtgccgcaatgtattttggtgaggagaagatgccgatccgtctctgctatatgggaaatacatttttaaacaacagcagctatcagggaagattaaaagagagcacacagcttggcgcagagcttttaggcgattccacggtagatgcagacgcggagatcattgccatggtgatcgactgcctgaaaaaagcaggattaaaagagtttcagctttccgtcggtcatgcagaatttttccgcggtttgacagatgcggcagggttaaaggaagaacaggaagaagaacttcatgaccttatttccaacaaaaattattttggtgtaacggagtttgctgagacgctgagcttaaacgataacttaaaggctctgtttggaatgctcggcaatctgtataccggatctgacgaattgcagacggcaaagaaatatgcatctgaatatccgcgtatcttagccgcgatcgagcgccttgaggagttacatcaggttttaaagatctatggcattgataaatatgtctccgtggagcttggaattgtcagcaattatcagtactataccggcatcatttttgcgggatacacgtttggaagcggtgagccgatcgtaaagggcggccgttatgatgaacttctgacttactttggaaaggagtcagcatccatcggttttgcgatcgttattgaccagctgatggcagcactttccagacagaagatcgaaattccggtacaatatcagaacgaacttattatttatgattcgaaaatgcgcagtgaggcgatcaaaaaggcgatggagctgcgtactgacggcagaaatgtggagctgatggcaagagatatctcaaagaccgaggaagattatcgcacctatgcaaagcagaatcactttgtgaatgtgacatttatgtaaggagacggatacgatggaagagatgagatatttaacctttgcccttgggaagggaagactggcgaagaaaactttagagatgtttgaacagatcggcataacctgcgaggagatgaaggacaaagacaccagaaaactgatctttgtaaatgaagaattaaaactccgttttttccttgcgaagggaccggatgtgccgacatatgttgaatatggtgcagcagatattggtatcgttggaaaagatacgatcttagaggaaggcagaaatatttacgaggtacttgatcttggatttggaaaatgccgcatgtgcatctgtggaccggaaaatgcaaaagagctgttaaaccatcatgaactgatccgcgttgcaaccaagtatccgcggattgcaaaagattatttctataataagaaacatcagactgtggagatcatcaagctgaacggatcaatcgagttggcgccgatcgtcggcttatctgaagttatctgcgatatcgtagaaaccggctccaccctgcgtgagaacggtttgtcggtgttagaggaagtttgtccgctttctgcccgcatggtagtcaatcaggtgagcatgaagatggaaaatgagcgcattacaaaactgatttccgatttaaagaccgtcatataagataacaaaaaccgtttgccacagcaatgttttgaatacagacggaacagatgttttgaaatggaggagaagtatgcgaattatagaactgacagaagaggcaagaacaaatatactggaaaatcttttaaaaagaagcccgaattcctatggtgaatttgaaggcagagtaaatgagatcatagaaaatgtaagggcaaaccgcgatgcagcgatctttgattacacaaagcgttttgatggagctgacatcaacgcagagaatatccttgtgacggaggatgagattaaagaggcctacgaaaaagtggatgaaaaactgcttacggtgatccgcaaggcgctggtaaatatccgcaaatatcatgaaaaacagcgccagtattcctggtttgattccgaggagtccggcattattttaggacagaaagtgactgccttggaaaaagtcggcgtttatgtaccgggcggaaaggcagtttatccgtcctccgtgcttatgaacattgttccggcaaaggttgcgggtgtaaaaactatcgttatgacaacacctcccggaaaagacggaaaagtcaatccggcgaccttagttgcggcaaaagaggcaggtgtggatgcaatctataaagtcggcggtgcacaggcgatcgcagcgctggcatttggtacggaaagcgttccaaaggtagacaaaatcgtaggtcctggtaatatctatgttgccctggcaaagaaagccgtatttggttttgtaagcattgactccattgcaggccctagtgagatcatggtgttagcagatgaaactgcaaacccgcgttttgttgcagcagaccttctctcgcaggcagaacatgacgagatggcatctgcgatccttgttacaacgagcagggatttagcggagcaggtatcaaaagaagtggaacgttttgtggcacagttatccagaaaagaaatcattcagaagtctttggataattatggttatatcttagtggcagaaagtatggacgaggcgatcgcgacagtgaacgagattgcatccgagcatcttgaacttgtcacaaagaatccatttgagacgatgacaaagatccgcaacgcgggagcaatttttgtcggggaatattccagtgaaccattgggtgattatttcgccggtccaaaccatgtgctgccgacgaacggaactgcaaaatttttctcaccgcttagcgtggatgattttatcaaaaagtcaagcattatctcttattcaagagaggcattagagccgatttataaagatatcgtacagtttgcagaatgtgaacagttaacggcgcatgcaaattcaatccgtgtacgatttgaagactagagaggaatgtggtaaaatggaaagaacggcggagtacatacgaaaaacaaaagaaacggatattaagattaatctgaatatagacggaactggtaaagcggagattgacactgggatcggcttttttgatcatatgttagaaggatttgccagacatggtttttttgatctggatgtcaaagtggaaggggatcttgccgtggactgccatcacacgatcgaagacaccggaatcgtgcttggtaatgcgatccgcaaagcgttaaaaaataaaaagggcatcaaacgttttggaagctgtattttgccgatggatgagacactggtgctctgcgccgtggatctctccggcagaccttatcttgtttttgatggcgaatttactgtggagcgggtagggtatatggacacggagatggttaaagaatttttctatgccgtttcttatgcagcgggtatgaatctgcatatccgtgtattgtccggcggcaataaccatcatatgatcgaagcaatgttcaaggcatttgcgagggcgttagatgaagcaaccggctatgatccgcgtatcacggatgtgttgtccacaaaaggcagcctgtaggaaaacttgcgattcctgcagaaatctgtcttaggtatatatcacaaaagaaaaacgtgtatggcttgttaagaaaatgcaggaatggagagtttttaaatatggaacacaaaaatattgttgccaccatttacttaaaaaatggacaggcagtaaaaggcatggataattttgaaccaatgggctgggacgtgatcagtctggcacgtctttataatgacagcggtatcgataaaatcatcatttttgatctctcagacgatgacgaagaacacgagaagaatatccataccatcaaaaatatcaaccgcaatgtcgagatcaaagtctgcgcaggtggaaacatcagccgctttgaggatgtcaagaaatttatttatgccggatgcctgcaggttattgtaaacggtgcaaaatcaaacagcatggatattgcaagagaggcgagcgaccgttttggaaaagagcgcatccttgtttccgtggcaaatgttgattttgtattcaaacatcaggaggagatgcaggagcattttcacgaacttctggttttaaacaccagcgttttgacggcaatcgaaaatattacagacgttccgtatgtcgtatattttgaggaatgcgattacgagaaaattattgagaccttaaaacgcgaaaatgtacgcggaattgccggatcttttatcaatgatcctgagacagatatcatggaaatgaaagcacagctctctgcaggcgggatcaagatggataatttcgaaccggcattaaaatgggcagatttaaagaaaaattcggatggcatggttccggttattgtgcaggattaccgcacggatgaggttttgatgcttgcctacatgaacgaagaggcttttgaaacgacgatcaatatcggaaagatgacctattacagcagaagccgccaggagttatggatcaaaggtatgacatccggacatatccagtatgtaaagtcactgaccgcagactgtgattatgatacgatcttagcgaaagtatcacagatcggtgcagcctgccacaccggaaatgtctcctgtttctttaatgagatcgtcaagaaggagtatatggagaaaaatccgctgaaagtattagaggatgtctatgcgattattttagaccgcaaggcaaacccgaaagaggggtcatacacgaactatctgtttgacaaaggactcgataagatcttaaagaagatgggagaagaggcatcagaaatcatcatcgcagccaaaaatccggatccggaagatatcaaatatgagatatccgatttcatgtatcatatgatggtgctgatggcggaaaagggagttacgtgggaggagatcacacaggagctttcacagaggtaatatacgaaggacatttacaggcagaaattacttgtaaatgtccttttgcaggttcatcatgaataacaaatatttatgaaagagagattacaatgataccattaaaaatagaaacactgttaaaaggccgcgtggttgaacatgatcgggtagaatataaaacaggatggaacccaaatgatatcattcattctatttgtgcttttgcaaatgattatgacaatacaaacggtggatatattgtgatcggtgtaaaagaagaaaatgggatgccggtatttcctttagaaggggtaccaaaagaggatctggattccatccaacaggaaatttttcagtattgcaatcagatcgttccaagatatattccgagaatggaaatcattgattatcagaattccggaatttttttgatttatctttggtgttctgctggtgacagtggtccatatcaggcgcctaaaactgtttatctggaaattgataatatcagacggggatatctggaagattttattaagaaaagcaatagcagcctgatcgaagaaatcaataacagtacgctcgaagaattactccttgccgaagaagtcgccgatgagacagatacagaattggatattagaaatatcggggttttaatgtttgcagaacatccggaaaaatttatcccaggatcatacattgagttaatccggtttaatacaaaagaagcagaggcatccgatgattttattgaaaaaacctttacaggtcctatctggaaacaggttcaggatgcattagattacattaacacaaatgttattgaagaaaaagttgtaaaacttcaggggcaggcggaatcagaacgattttttcataaatcatatcgtgaacaggaacctgttgaaatccggatttacgtcgacagtatccagatactcaattatccgggattggcaaaatggattaatcttgagcgatttgccgaaggcaggatcaaaggcagaaaatacaggaacagacggattggagaattatttaaagaaattgatttgtcagagaaaaaaggcacaggtattcccaaaatattacgtgaacttaagaaaaatggttctcctggaccggaatttgatatggatgatgacagaacatatttgaatacaattattcatatccgcgatggatttgataaaaatgagattatgtccgaatcaatgtccgaatcaatgtccgaattagaaattgccagaatacaggtaatattacaatatctgactgttcatgataccattaacagtgcaaaagcggctgaattactggatgtagagaaaaagaccgcaagccggctgttgtcaaaagctgaaaaagtagaagttctgatcagcaaaggcaaaacgaaagataaagtttatatgaaaaaataattttggtatatcagataaaatcctgaaaatgaaaattggagactccatgtttgaaaaaataaaacaacttatgactggtaatctgtcaaaaggcggcaggcaggtctacatcgatgatctgcgcgtcatagcgaccgtatttgtgatcggggtgcatacagtctcactggctgccacgatgacagaatacggaagcatcccattccgggtgcttaccatctttaattttatatttttgtcctgcaacctgctttttgtcatgttaagcggagcattattgctcccggtaaaaaatgaatcgatcggcaattttttccggaaacgtttcacaaaagttgcaattccgctggttgtctattacattctgtatatcgtggcaaaggaagggcttgtctggctgagaccggaccactggattctgatgttgaggcgtattttaacgggggctccaatggaggcacctcatttctggctggtctatgtgatcatctggctgtatgtactgacgccgtttatgcggtatattgtacataatattcccgataccgtattgtcgggtgtgataggggtcgtatttgcaatttgtgcattggacacctatctaccactttacggaatcaactctgtgtttggcattgtggtggattcttatgcgggcacttttttacttggatattttctttctgaaaaatgcagcagaaaggtagaaaattttttcatgtttacaggatttctatcatttattgaaacctgtatgtggatctggaacggaaatgattatgtcaattatatttatcagaattcgcccacaatgatgtgttttacggcagctatctttttgttggtaaagcgccttgcgtcccaaaaaacaaaaagcagtttctttgtgcagtggatcagccggtacagttattctattctgctgatccactggggcgtacttcattttgtggtcaaacagaaactgcatgtcaatgtgctcggcggtggcattgtcggcggctgtattgtgatgatggtactgactctttttatctcagcaatcggtgcaatgatccttgacaatacgctgctgaaatggctccagaaaccttttacaaaaaagcagagacagaaataaaaatacaaggtatgaatttgtccatagattcataaaatgatatcaaaaatcagaataaaaaaacgatgtttacttaaaaacggtcactggtatacataatatttttatggtaaaccagtgccgggacacagaactgctgtatgaaatcagtcatataattttatgcagatggactggcacagaaatggagtgttctatggacagacagacagtcgaacggcgcagggaatatgtgcagaatatccgcaattctttttatgaggaaaacgggatgcagaagagagagaccagagaggtggatgattctgcaccggaaatggggcttgcggcagcactgaaactgcgcatttttttatctgtatgtatatttgcagcttttttaggctgcatgtatacccatacggatttgtgtggttacagcacgcagacgatcacagaaatgatctgtgataatcattattatacaaatctgaaaaattatgttatgatacattgagcgcaagtgagtcaacatacatgtatgattgacgaacggcgaaatttgagcgcgaaagaagaaatggaaaggatttttttaaatgacaaaattagctttatccgatgagatactgatgaagattgataaaccggcgcgctatatcggtaacgagttaaacagcgtggtaaaagagaaagatacggttgatatccgatttgtgatgtgtttcccggatgtttatgagattggaatgtcacatcttggtatccagattttatacgatatgttaaataaaagagaggacgtctggtgtgagcgcgtctattccccatggccggatctgcatgcaattttaaaagaagagaatatcccgttattttctttagagtcgcaacagccggtaaaggatgcggatttcttgggaattacgatacagtacgagatgtgttataccaatatcttacagatcttagatctaagccagattccaatcgaggcagcagacaggacggaaaatgatccgatcttaattggcggaggtccatgtacctataacccggaaccgattgcggaattttttgatctgttttatatgggagaaggcgaaatttcctatgatgcactgctggatctgtacaaaaaaatgaagcaggaaggagcttcgcgcaaggattttttacatgaggccgcaaagattcctggtatttatgtaccatctttatatgaagtaagctataaagaggatggaacgatcgccggatttgaaccggtgtatgaggatgtgccgcgcacggtcacaaaacagattgttacagatatgacgcaggcagtttatccggaaaaaccgattgtaccatttatcaaggcaacacaggaccgcgtggttcttgagatccagcgaggctgtatccgtggctgccgtttctgccaggcgggtatggtctaccgtccgacacgtgaaaaagatgtggaacgtttaaaaaaacttgcgtaccagatgttaaagtcaaccggacatgaagagatctctttaagctctttaagttcttccgattactcacagttacaggaacttgtgacatttttaattgaggaatttaagggaaaaggtgtcaatatttctcttccatctctgcgtatcgatgcattttccttagatgttatgggaaaagtgcaggatatcaagaaaagcagtctgacctttgcaccggaggctggttcccagcgtctcagggatgttatcaataaaggtcttacaaaagaggttatcttagaaggtgccggaatggcatttgaaggtggatggaataaggtaaagctttactttatgttagggcttccgaccgagacagaagaggatatgaaggcgatcccggaactggcaaacgatattgcggtacgttattatgagattccaaaagatcagcggaatgggaaatgccagatcacaatttcaacatcgttttttgtgccaaagccttttacaccgttccagtgggcatccatgcatgacccggaggactatattgcgcgtgcgaaagttgtcaatgacacggtaaaagagcagttaaaccgtaaaagcatcaaatacaactggcatgaagctgatgtgacggtgttagagggtgtattagcacgcggtgaccgcaaggtcggaaatgtgatccgcacggtttatgagcgtggcggcatatttgatgcgtggtccgaatattttgattaccagagatggttggatgcatttgcggaatgtggcgtggatatggatttttacaccaaaagagagcgctcacttgatgaagtatttccatgggatttcattgataccggcgtgacgaaagaattcttaaaacgcgaatggcaaaatgccatggaagagaatgtgactccaaactgcaggatgcgctgctccggatgtggtgccgcccagtttaaaacaggggtatgtatggcagagcgttaaaaaagatatttaacgttttacatgagatacttaatgtgaaagaagaaagggttaatgtaaggttgacattatgataaagataaggattaaattccgtaaatacggtgtgatgcgttttatcggacatctggatattatgcgttattttcagaaggcaatgcgcagggcagaaattgatatctgctactcggaaggcttttccccgcaccagatcatgtcttttgcggcaccgcttggtgtcggaatcaccagtgatggagagtatcttgatattgaagtaaattctaccagatcaagcgaagcgtctattaaggcactgaatgataccatggtggaaggtgtggaagtcacagagtatgtaaagctgccggacaatgcaaaaacagcaatgtccatggttgcagcggcggactatgaccttttctttaaagaagggtatgaaccggctgcagacgttagaacttttgcagatggcatccgtcagtattttacggaaaaagaagaatttctgatcacaaaacagacgaaaaaaagcgaaaaagtcatggatttaaagcagcttgtatatgcatttgatgtgtcagaaagagacggcagaccggtattttatttaaaagtatccacaggaagtacggataacctaaagccggaacttgtactagaagcaatgtttcaggcaatgggatatacttatgaccagaatacgatccagattcaccgcagggatgtctatgccatggatccggcaggagatggatttatttcccttgggaaaatgggggaagtgatcgggtaatatgaaccgttttattattacaacaacagaaatcgaaaaaaaagaataccgcattgcggcactctgtgatgccagacaaaaactgatcgaagtgaccacggaatccatgaccgggacatctgtgcttggaaatatttatataggcagggtagaaaatgttgtaaaaaatctgaatgctgcctttgtctgcatcgcaccgggacagaactgttacctgccgctgcaggaactgaaaaatcctatttttaccaaaaaacaatcagaaaaaaaagcaatttgtgcaggggatgaacttttagttcaggtggtaaaagaagcattaaagacgaaggatccttccgtaagtacgaaccttacgtttaccggaaaatatgtgatccttacgactggaaaacgaaaaatcggtgcatcttccaagctgccaaaagagaaaagagaaaagctgttaaagatcgtagaagattttctttcaggcaaagaacagattccatatggtgtgatcatccgtaccaatgctgcgcaggcatcaaaagaggaactgcttttggaattggcacagcttgaggcagaagttcaaaaaatcatctcaggcgcaaaatatttgatccgctattctctggtacataaagaggaacagccgtggcagaagatgttaaacggactttatgaaacagaactgggggaagtggtgacggatgacagagaaatctttgagacaatctgtaacatgtatggtgtcggtgcaaaacagcttgtaaccgggggcagtgtgagatccagggtagatgaaatactcaccggacatggtcttaaaatccgctattatgaagatgaaatggtttcattatctgcacttagcgggatcacatcacagcttcacgatgcattgagggagagagtatggttaaagtcaggtgcataccttattatccagccgacggaagctctgacggtaattgatgtaaataccggaaaaaacattgccaaaaaggaaatgcaggaaaacttccttaaagtaaatatcgaagctgcagaagaaattgcaagacagttaaggctgcgcaatatttcagggattgtcattgttgattttatcaatctggaagcaaagtcggcagagagtgaacttttaaatgtttttggagcggcactgaaaaaagatccggtaccaacgcagatcgttgagatgacaaaactcggtcttgttgaggtcacgcggaagaaaatcaaaaaatcactgcgggagagtttgtcctgacacaatctggaacattttacggacatttgagtatcatcaaaattaagaaagtatagagagaataaaaatgaatttaagttttattgagattttaaaagtaatttttcttggaatcgtggagggaatcacggaatggctcccgatcagcagcaccggacacatgcttttagtggacgaatttttacagctaaacgcaagtgattcctttaaggaaatgttttttattatcattcagcttggtgcgatccttgcggttgtagtcctctactggaaccggatgtttccgttccagtttaaggataaggcgaagcctgtgataagaaaagatattttttctttatggtttaaagtagtggtagcatgtattccgggagcggctgtcacaatattatttgacgattatatcgaagcacatcttcacacaccggttgtgattgcgatcgctctgatcttttatggtgttgcctttattctgattgaaaactggaataagacaagagagccaaagatcaaaacacttgcggatatttcctaccagactgcatttatgatcggattgtttcaggttctttccatcattcctggaacttcacgttccggtgcaacgatcataggtggactgatcataggtgtctcccgtgtagctgttgcggagttcacattctaccttgcagttccggttatgctcggcatgagcctcttaaaactcttgaaatttggattcgcatttaccggggcagagcttgtgatcctgggagttggaacagtggttgcatttcttgtatccattgttgtcatccgctttttgatgtcctatatccggaaacatgactttaaggtatttggatggtaccgtatcgtgcttggagcgctggtgctggtttattttgctttcagataaaaatattttataaatttgtaaaaaatggttgacgtaacaaaaaatatatgctaaagtaacgaagtatgccgcacagtgaggtctgaaagtccgtctatactgtatcaatcacagatagaaggcaccataactggcgagtaatgataataggaggtgccatatgtacgcaattatagcaacaggtggtaaacagtacaaagtatccgaaggcgatatcattaccattgaaaagctcggaaaagaagctggtgagaaagtaacttttgatcaggttttagctgtatctgacaacggtatcaaagttggttctgatgtagcaaacgcttctgtagaggcttctgtcgtaaaagagggcagaggtaaaaaagttatcgtttacaagtacaagagaaagactggctatcacaagaaaaacggtcacagacaggcgtttacacaggttaagattgaaaagatcaacgcgtaatcgacagggaaagttgttatgacaaagataacgattttcagaaaccgtgacaacgagtttttaggctttgaatgtcttggacatgccggatatgcagaggaaggcgaagatattgtatgtgcagggatttccgcattggtcatcaatacggtaaacagtctcggcttatatacgaaagatgcctttttcactgattcggatgaggagacaggaaagataagcttatcgttttcttccccggcaggacatgatgccgatctacttatgaagtcattggttttaggtttgcagggaatacaaaacacttatggaaatgattatatcattctaaaattcagggaggtgtaagacatgttaaatatgaaccttcagttttttgctcataaaaagggagttggttctacaaagaacggtcgtgattccgaatctaaaagattaggagcaaaaagagcagacggacagtttgtaaaagctggaaacattttatacagacagcgtggaacaaagattcatccgggcgttaatgtaggtatcggtggagatgatacattatttgctttaacagatggtatcttaagattcgaaagaaaaggaagagataagaaacaggcttccgtttatccagtagctgaataagatgtactgtggacccgactatgaacacccatcacagatggcacatccatcgcagatggatgtgatagccgggttctatttgtattaagaatgtgacaggtaattcacatgtattcaaagtcaggttgaaccctgctttatgtacgtgtttttgttaaatttgaggtagaaaaatatgtttgcagacagagcaacaattattataaaatcaggaaaaggcggggatggtcatgtcagtttccgcagggaaaaatatgtgccggacggcggtccggatggcggagacggcggccgcggcggtgatatcgtattcgtggtcgatgacggtttaaatacacttaccgactatcgtcacagaagaaagtttgccgcacagcctggagaagaaggcggaaaacgcaactgtcatggaaagaacggcgaggatctgatcttaaaagttccggcaggaactgtgatcaaagatgcagagtccggaaaagtaattgctgatatgtccggtgacaaccgcagacaggtgatcttaaaaggcggccgcggcggtcttggaaaccagcattttgcaacatctaccatgcaggcgccgaaatatgcacagccgggtggagatgccattgaactggaagtaaaattggaattaaaggtgatcgcggacgtcggtctggtcggttttccgaatgttggaaagtcaacgttattgtcaagggtaaccaatgcacagccaaagatcgccaattaccattttacaaccttacagccaaaccttggtgtcgtagacttagatggtgcgaagggatttgtcattgccgacattccgggactcattgagggggcatctgaaggtgtcggactcggacttgagtttttgcgtcatattgagcgtacaaaagtcatgatccatgtggtcgatgcagccggaaccgaaggacgtgatccaatcgcagatatccgtgctatcatgaaggaattagaggcatatgatccgaaacttttagaaaagccgcaggtgattgcagcaaacaagatggatgcggtgtacggtgatgagaatgagatcgtccagtctttaagacgggagttcgaaaaagacggaatccgtgtattcccgatttctgcagtcagcggaaagggattaaaagagttgctgtatcatgttcaggagctgctcgatcactgcgacagcgagccggtgatctatgagcctgaatttgatccggcactgcgattctttaaggatgagccttatacgatttcacaggcggcagatggagcatttgagattgagggaccaaagatcgaaaaaatgcttggttataccaatatcgattctgaaaaaggatttttattcttccagaagtttatgaaggaacagggtattttaaaagaattagaagcccagggaatcgaagatggcgatactgtgcgtatgtatggatttgaatttgattattataaataataagaaactgatgtgatattaatggcactgggaaacggtgcggaaatgaggaatgttatggcattaacaagtaaacagcgtgcataccttggcggatgtgcaagcacgatggatccgatctttcatattggaaaagcaagccttacaccggagatcattacagcgttagacgaagcattagaaaagagagagctgatcaaggtggctgtattaaaaaactgtattgatgatccgagagagattgctgcagtgactgcagagcggacacgttctgaggttgtgaaggtaattggaaagaagatcgttttattccgtcaggcgaagaaaaataccaagtacgaactgccgggctgatatggaagatgcagagtgcaggatcggacaaaagcatttaaagagggtaggcattttaggcggttcttttgatccgattcataagggacatttaaatattgcgcagagtgcgtatgaagaatttgcattggatgaagtatggtttattcccgccggacattctccgaataaagacgagaaaaaaatgacagcggcagatatccgggcggaaatgacagctctggctatctatgatattccatattttaaactttcacgaatggaaatcgatgcagaggggacaagttatacttatctgacactcacaaaattaaaagaggcttgtccggatactgattttttctttattatgggggctgactcccttgattatttagaaaaatggtatcatcctgaaattatctgtgagaaggcagttattttggctgcagtacgtgatgatatggatttgtcggaggttgagaaaaagatttctgccttaaaacagctatttcctgctgaaatctatccaatcgagggtggaaaaacagatatttcatccagtgagatccgtgcggctttaagacgcggaaaaacagatatttcgctgattccgcctaaagtactggcatatattcaggaacatcatttgtatggggaggattagatgataatacatgcaattatgtctgcgcaaatctgacggcagcgtctcctcgcaataagctggtctgaaatggagattatcatggaattaaatgaaattcgaaaaaagttaaaaaaagaactggataagggtcgttatgagcacacgaaaggtgttatgtacactgcgggctgtcttgccatggcacatgagtattccatggaaaaggcaatgcttgcaggattacttcatgactgtgcaaagtgtatcccaaatgatcagaaaatagaaatgtgtgaaaaaaatcacattctgatcaatccggtagagtataaaagtccgtatctgctgcatgcaaaattaggggcatttttggcggaaacggtatatgaagtatcggatccacagattttacatgcaatcaaagtgcatacgaccggtgaaccggatatgagcctcttagacaagatcatttatattgcggattatattgagcctgggcgggataaggcagaaaaccttccctatataaggaagatcgcttttgaagatctggatgtctgtatggcggaaatcctgcatgatacgctggcttatctatccagccgtggtggaagtatcgatgcaacaacaaagatgacctatgatttttaccgtcaatacaggaaaaaccatgattgatgtttcaagtttaaacatgcctttctggtgtggtgtatgaagccattgccgggaaaataaacaaaaataataggagagtgtagatttatgacttcagcagaatattgtaaaatagcagtgaaggcactggaagacaagaaggcagaggatgtgaaaataattgatatccgtgaaatttcaccgatcgcagatttttttatcattgcagatggaatgaaccagaatcagattcaggcaatgcgtgatgcggtagatgaagctttatataaggcagatcttaaagtacggcaggtggaaggcaatcagtcttctacatggatcctgatggactataatgatatcattatccatattttctcgaaagaggacagacttttttatgatcttgagcgtatctggaaagatgggaaagagatcagtgtggatgaactgtaaaaaaatagtgatatgttttgtaaatagttttatgaacataaacggaaaaggcagctgattgttaacatgaaaatcagctgccttttccttaatttaaaaatcgcataataccgaatactttaccaagaatcgaacattcattcacaatgatcggatccatggtatcattttccggctgcaggcgaaagtgaccgtcttctttgtaaaaagtttttacggttgcggaatcatctacaagcgcaacgacaatatctccattctgtgcatctgattgtttctgtacaagaatcttatcaccgttaaatattccggcattaatcatactgtccccttttacctttaacataaacgtttctgcatttggcataaactcagtaggaatcggaaagtaattttcgatattctcaacggcaagcagcggctgaccggcagctacctgaccaatgatagggacatttacgacttcacgtcttgttaagttgaaattgtcatcaatgatctcgatggcacgtggttttgtaggatctcttcggatataaccattcttttcaagagtctcaaggtgtgaatgaacagaagaagttgactttaaatgaactgcttcgcagatctcacgaactgcaggtggataacctttgtttaaaatttcctgtttgatatattctaaaatttctcgctgcttactgctgattttgccatatgccataaagtgcctcctattatacgataaaatgtattttatcaatcttgtaaggggatgattctgccctgtatttattttatcataaaacaaatgaaaatgcaaacgtatattccgaaaatttgttcgatttttcacttgacaaacaaatgttcgtgcattatgatacagatatacaaacagctgttcgtaacaaatgttcgcatgtgatggagggtgtttatgagaagcagaagaaaaagcgggaaaaagcagaaatcagtttttttgatcgcattatcaatggtactatttataataatgtgttccgcatgttttggtacgatccgggcacaggcggctgatgaaaccagtgcctataaatattataccagcatacagattaccccgggacagacgttaaatgacattgcagggatttatatgaccgatgattataaagatacctcagcttatatagaagaggtatgtatgatcaatcatatctttccggatgatattcatgagggcgaatatctgacagtgccatattattcagcagaatatttaaaataggtgcccaaatagcagcgcaaaacagcaacaaaacagcaacaaaacagtaggaacaaaacagtagtctgtggggatgttgtatttttcttcaaaataagctataataattatattcggcataaaaatatcccgatggaagtggtgatattcagggtatatgccaggtacggaggatagcgttgaagatatgttaaagtttatttatgtaattcttatgaaccttttcagagcaccatatatgattccaaagatgcataaggaagcggatcatcctgaaaaatattcagaagaagagcgatatgagcttgcgcgccatgtgattcgccttatgaaaacgactggtggaattaagacgaaagcatatggtctggaaaatctcccgtcagagggcggctatatgatgtatccaaaccatcagggaaagtatgacgcacttggtattatttatacccataaaaaaccgtgctctatcgtcatggatcgtgcaaaatccaatacgatcctcgttcgggaatttatcgatctgctgcagggaaaacgtctggataagaaggatgtaaggcaggcgcttacaatcattaatgaagtttcagaagacgttaaaaaggggaaacgttatatcctttttccggaaggcgggtacgatttcaataatcgtaataatgtatgcaatttcaaggccggtagttttaaaattgctttaaagacaaaggcaccgattataccggttgccctgatcgattcctataaggtttttaacagttttaatctgggacctgtgacaacacaggtacactatctgaaacctattttatttgatgaatatggttcattgaaaacacatgagattgcagaactggtacagcgcaggattcaggaaaaaattgacagtatattgttaccggagacataatatatgaaacaatagaatgcatcttccatgaacattctattgttatgaattagaaaaagtgttatatgatataaaatgtcatatagcacttttttaataatacacagaaatcagatctcacgtaatttgacatatttcgcagcactccggcgtctttcatcttcaagtgcagcatagtgcttacgggtagtattgacatctttatgtccaagaacatcggcaaccagatagatatcgccggtttcgcggtagagggatgtaccgtaggtactccgaagtttatgcggtgtaatatgttttaaggttgttacaagcttggaatatttttttaccatattttccacggatctgacacttatgcgcttgttttgaagtgataggaagagcgcattgatacttccgtcggctgcagtgattttctggcgttccaccatataatccatgagagctctgcggacttcctctccaaaatatacgacaacttctgcgccacctttgcggtggattttaatgccgttatttttaaagtcaacatcttccatatcgaggccgacacattcagaaacacggataccggttcctaaaagaagtgtcatcattgccagatcccggatttttgtcttttcatgatactgttgctgtctcgcagtaagattctcgccagattccacttcgtcaaggagctttgccacctcatcgacatccagacggataatattcttttcatgtattttaggcatgtctactttaacagttggatcatcttcaatcaagccatttttgtaataataatgataaaaggagcgcagtgcagaaagtttacgcttcaaaccaccttcatcattggtgtgttccgttccgtctttttcgtagtattttaaataagaaagatattcctcaatatccattggtgtaatttcatttaaaatagagattggaaaatctgtaatatccattttagcacagaccggattggtagcatgcaggtaatcaaagaaacacccgatatcatatgcgtatgcaatttttgtcctggaagagcttgttgcttcaatgccaataaaaaactgtttgcaaaagggtggcagtgtttctaatagttttcttaactttacttcattctttacgtttattgtttcataatatgctttttctttcattgtgatctccattttaaaaaagtaacataaggcttaaattgcattattggtaccggacagccatccttgtatatttccgttctggattgcatgaaaaagtttcgtcttaacccccggattgtctatatttaactgctgtatcagtttctttacatattcgcgtttggtattaccgtccatcggacatggattttttacaacaggaagctgatacttattccggaatccttttacttctgcctcagatacataaatcagaggacggattatggtaagatcagaatcttccatgtaggtttttgggggaaatacataaaagcgtccctcaaagatcatggataaaaatgctgtttcaatcacatcatccatatgatgtgcatatgccactttattacatccgagttcttttatcgcctgattcaaggcacctttgcgcatttttgcacataaggaacaggtgggtttttcatttcgttcttcaaagagaatctttgctatttctgtatttacgatatggtatgagacgtcaagatcatgacagagttttgaaacagctgtaagatcaaaattttcatagccaagatctacggtcacagctaccagatcgaatttttggggataaaagcggcgcagaccactcagtgcatataaaagtgtaagagaatctttgcctccggaaataccaatggcgatcttatcgccggactcaatcaactgataatgatcaattgcttttcgcgtgtagctgtataattgctgtaatttcatatgcaggcctcctgaactttctttattatacaatattttaaggcaaaggtatattaatttttaatccggatgatgcaggataaaattattactttttttgtttaatgtgggaaagtatatgcaaattgttaaaaatatgttaaatttatagtaggatttatggttatgaaatttggtataaaaaatggatttgaaattatgaaaaaaggagtagatatggatcatgaaatttatagtacaacgcgtatgttcagccgcatgtcgcgtagatgatgaggtaacgggcagtattcaaaaaggttttatggtactgattggcatatccgattctgatacgaaagagattgcggataaaatgataaaaaaactgatcggacttcgtatttttgaagattctgaaggaaagacaaatttatcattgaaggatgtgaatggaagtctgttattaatatcacagtttaccttatatgcagattgccggaagggaaataggccatcttttacagatgccggtaaaccggacatggcaaaagaactttatcactatattattgagagctgcaaaaatcagattgcagttgtagaacagggggttttcggagcagatatgaaaatatcccttgtgaatgacggaccttttacgatcattcttgattctgatgaactcatacgatgaaaatcgtaagaatggttgatttttttgaaaggaaatttgaaagaaaggaggaaaatgattttggaatgctatttggcataacaggatttatgctgggtggtatacggtttattttgattggaattattttagtataatttttatatggtataaatgtcagtgcggggaacgggctgatccgcccggaaagttcttttacttacaggttgcatgtggaaacaatgtaaaatcagaggctgttaagaccaacatttttataaagtcgaaagcatccagattcattggtactgatacaaaagtcagcgaaaatttcaaatttggaaatggagttggttataccgtaccgggagatgttccagtcattggcggaacagcaaagaagaacctcaggaaacggatgaaatggcttctgagaaaacagtcgaaacggaagaagcagtaactgagaaagttgaaaccgagacggaagaaatagaagagattcagacggaagaagcagaaactgaaaccgaagaaaccgaaaccggggaaattgaaactgaggagattgaaaccgaagaagtcgaaatagaagaaactgaaattgaagagactgaaacggaagaatcaaaagacagacacaagaagtctgttaatttgaacacgacagagcagattaaagatcttgccggaagaattgaacttgcatttgcagtatttgacactaccaacaatacatttaccaaccagcaatttataaaacgtccgatggaatttaccatattgtattcgggtattatgatctcaatgatgcggatgagtttatccttgcttaccaggaaactgttgaagcaaatgaccttgtattggaaaatgtgagcgccagcgaacaaaattatgcaaacggcaggcagacagcgacaatttccgttggaaatgaaggggtgaaagatgcatcaggatttactgttgatgtatatgaggatgatgactggatcgataccgtggatgtaatgaaagtattgcttcaggagaagaaaaagagattgaaattacattttcaaaatccgtatcgaaagaagtgcaaacatacaggtttgtgatcaatcaagatgaagatcgcaatacaaaaaataatgaacaggaaattaaactcggatatgcagatgtttcgctaaaaacaacggaatattatcatgataatatcattgatgtgtatgcacagatttctaatctgacagcacgaaatgcagatgtggaactgaaagtatacgaagattcgttagatggagatattgttttccagagaacgatcaaagatgtcacgaatgcagattctgttgttgttccatttgaacttgacagaagtaaaatgaatgttactccgggaaaagacaaactttatattgttaaagttacttatgattatgacacaaataaaaataagagttatcagctgacagcaacaactacaccgaccggagtaaaagcaaatgtaaactggagcagttctaataatgcggtggcgacaatagatgcttccagtggcaatttaacaatcaaaggaactggaacagccattattactgcgaaagcagatgactcagcaaaggcaacggtgacagtaacagtaaagtccgtagataaaacggcaccgaaaaatgtaaaggtgaattctgtaaaagtagatagtgttaccttaagctggaatgcgcttactgctgtttcaaataaaggaaaatttacaaaagtttctaccgttaaaaacgcgaaaaaaacaactttccttgataaaaaagtttcttccaaaaaaatgtattattataaggtacgcgcatataaaactgtgaaaggtaaaaaaatatatggcgcatattcagtagtaaaaaaagtaaaatgtaaataatatagatttatttgcaggctgtcattcagaaaaatcccgtgttaaccagatatttatcttaacacgggattttcgtatggatgcattgatgataaagtttgtataaatttatatgtagcagagtgtatttgagttgtttgattgtcttttcttctattcgcaaaacacaagtttaacgaatagttgcattcggaagcaaatagtctgtagcttattaactcaatatacgctgtgtcggcaacaaaactaatcaatttgcaattatcatttttacaaaaaaatccccattaaggctatacaccttaacagggacttttctccgggatatttctattttatttctgtgcatccataatttcacggaattttaagatcatgtcgacacatccgtcaataccaagctttccggcatccagtgtcagatgatagctggtagaatcaccccagcgcttgctggaataataattataatagctggcgcgttgtttatcctttttctggatcaggtcttttgccttattctctgtgatattcaggcgtttgctgacagctttgacgcggttttccatatctgaatgtataaaaatattgatgcagtccggataatctgccaatgcgtaatctgcacatctgccaacaatgacacaggattcacgatctgcaatctttttgatcgtttcaaattgtgcaaggaatactttatggttcaacggcatatcaagaaacggtgaagaattgtagcttccaacggagtatgtatccatgaccagtgagtataaaaagctgctggttggtttttcatcgtgattttcaaaaatctcttcgcaaaagccactgtctttcgctgcctgctgtaataattctttgtcgtataatttgatgccaagtctgttggcaagtgcctcaccaactgctttacctccacttccaaattcacgaccgatggtatatatcttatttgacataggaatcccccactttcttttgcagcagaatatcttacatattacgaaatatttgtgcaatacatgcaaaacgcctcgttttcatatgatgatatctgtttcttttgtataattatactacattttttcaaaaattaaaacaattttccggaatttaatgcaaactttttagtattttcaaaaaatattctgggagtggtgccgatatttccatatattcattagtacgcggatgaataaaaccgatcgtcatggcatgaagtgtctgcccttgcgttttaaacggactttttccactggaatatacggtatcgccaagtaacgggtgaccgatacttgccatatgaacgcggatctgatgtgttctgcccgtctctaatttaaattccatataggtataattcgaaaaacgttccagtactttataatgtgtgatcgccggctttccatttttctcgttgatcgccatctttttccggttggtcggatgtctgccgatcggagcattgatcgttccttcatcgtcttttacaacgccatatacaataccgcggtatctgcgattgacactgtgctctttgatctgctctgcaattttaacatggctctcatcatttttacatacaatgagcgaaccggttgtgtccatatcgatccggtgcacgattcctggccgtatttcgccattaatgccagaaagactgtctttgcagtgaaacataatcgcattaactaaggtgcctgaataatgccctgctgatggatgtacaaccattcctttcggtttattgacaacgagaaggtcatcgtcctcatataaaatatcaagcgggatatcttccgggagaatcggtgtttccacggcgtctggaatttccacacatacaaggtcatccatacgcagacggtaatttgcttttgctatagaatcatttacttttacatggccgtctctgatcagtttctgaaaaaaagaacgtgaaggtgcatttgaagaggtttttgactgctcaaaaataacgcttagatatttatctaagcgttctccctcatattctgcctctatttcgaaagtttcctgtttcataaaatctccattctggtatgtatattcaatggtatacaaaaatcatgatttcttttttgtgggaagaatacgttcaaagtcttcttccttataaaacagcagacataagatcaaaagtacggcagcaacggtcacataaatgtctgcgacgttgaacaccgggaaattgatcagtctgaaataaaagaaatcaaccacatatctctgcgtaacccggtcaataaagttaccgatcgcacctgcaaaaaacagaatggcgattccattgagtaagccaaaatgtttttccgaaggaatgcgcatcagataaaaatatatgataaggatcagaacaatcacggtaaaaataataagcggccactgttttccctgaaaaataccaaacgctgcaccacggttctctaaataactgagttccaaaacgtttttccacaaaacaacaggcatctgatctttcaaatgctgtactgcaagatattttgtaaactggtctaaaaaaatcagaatgactgagcataaaataccgataaaagcttttttttgaatggttttagattgttgtttcattgagccctcatttctttggaaatcattttaggaatggcagacataacggataccgtcaagaatctgttcatctgtcagttcgcggtagatataagcatttccaatctcttttaacagaataaacttaacctggtttccaaccatttttttatcggattttgttgcagaaagaactttttctgcgttaaatccatccatctgtgttggaagttcaaaaagcgataaagcattttgtattttctcaaaatcttcttttgaaatatggccaagctgcatggacagataagatgccgcaacaataccaagtcctacacattctccgtggtaaagcgaaaaatcagaaagcttttcaatggcatgaccaatcgtgtgtccaaaattaaggagtgcacgctctccctgctctttgggatcacgttcgaccacatcacgcttgatattacagcttatgtagatcatttcttctaaaatttcaggatctaatgcccagatctctttttcatgagcgatgagccattcaaaataagaagcatccttgatcaagccatgcttgataatctctcccattccggaaacaatctgttttcctggaagagaatgaagcactgacaggttcatataaactaatttaggctgataaaatgcaccgaccatatttttatactgcataaaatcaatacccgttttgccgccaatactgctgtccacctgtgaaagcagtgtagttggaatctgtatgaaatcaatgccccgtaagtaagttgctgccgtaaaaccggtcagatcaccgactacacctccaccaagtgctaagaggatgtctcttctgtcgaagtgattttctatcagaaactgatataacgcacctacggtatccgtgtttttgcttgcttcacctgcaggaaaaatatgtaaaaatacatttgaaaataccgcagaaagctgatcctgtacttcctttgcgtataagggtgctacattggaatctgtgacaatacaaagtttctggtcaggactgattttgagtctggtcagttctttacaaagatccccaaaatctttttttaattcaatcgtatagatcacatttgttccatctgtaaccggtatactttttgacataatactcctccgtttctgcatttttgcatatgagcgtactgttaacttttatatagctggtatttgattttcagacgtcctttattggtttctcctgagatggaaataaaatgaaaacgcccatgaccgcgcacggatataatatcatccggcttgcagatataggttggtgtctgaatattttttccatttacaaatacacggtctgcgcggatcagttctaaagactggcttctggataaacggtatacacaggcaatgacagaatcaagtctgtttgaggtaatgatgccatctttatcgatcatctcctgatgcgaactgatttcgtctgtacttacaacacttaagcgcaccagtgtatgacgaacttttgtgagctgttccataaagtatggagccacattttcctcacacaggatataataacagccgtctcccatcagaatatcaccgatctttgagcggtctataccgagtgtcatgacagatccaagcaggtcacggtgacctaatttttctgcaaacttcggataagcgggttccacctttaatgccgcaatcgggtatgtccattcataataaagagcatcaggaataaaagcaattatctgacgctctgcataggaaaccccgccaaaactctccgtctttgtggcaaattcggattcacactggtggtaaatattcagttcatttaaattaaggaaatcgctgaataaaacgattccctttcggtcagcctgtctggaaagatccaacagacgttttttacaaagttcctgctcattcataattaaaaatcggtctgaataccccttgtctcaaatgaatccattaaacttaaaaaatctccggaaatatccacagatgccggtgtgataatgaagatgtaatttgaaatcttctgcagattaccactgattgcaaagcatgaaccggatgtaaaatcaatgatacgctgcgcaatctcaacgtcaaggccctcaacattgaggacaacagtacggttctccagtaaagtctctgtaatttctctcgcatcttcaacagaagtaggtttgatcacacatacctgcataccgccgggaccagtctgttttttcgatggacggatcggcgttaccttggatgaggattttaccggagtctccttcggacgatctgaatcataatctttttctactgtttcacgtttcttctcgcgacggaatgtctgctttggctcgtcctctgtataatcatcatcgtaatcgtaatcttcattgtaaaaatcgtcgtcatcctcaggattcagacgcataacatttaaaaatttatcaagaactcccatgttctcactcctgtttataatttctttcaccgaaaattccggttcctacacgcaccatggtagcgccctcttcgattgcaaccatataatctcctgtcattcccatagacagaatttccataaatacattatctatgtttttattagttatgtcaacagataattgctttatttttcggaaatacagacgattatcttccggattttcaacataaggcgcaatcgtcataagtcctttgatacggatattttcaagtttggaaatctcttccacaagtaggattgcatcttctgcggaaataccaaatttagactcttcatgtgcaatattgacttcgacaagaattggaacgatcacattctgtttttttgcctgaatgttaatctcttctgcaaggcggtatgtatccacggaatggatcaactcaacttttcccacaatatactttactttattgcgctgaagatgtccgatcatatgccagcggatatctgatggaagctgctccatcttgctgcagagttcctgtactttattttcaccgaaatcacggatgttttcgtcgtaaatttcctgtaacatttcaacgggtttcgttttgcttaccgcaatcagggttacttcatcgcggctgcgtccggcatttttacaagcctgttcaatatttttttcgacattggcaagattttcttttaacatatcattttccctccattattttaacaaatcatcttcattgatcttcgctccatctaaagcgatgtggtcatataaggaaattccataggaagttccagtttttacgatggtatactccttgctctgataaaggatatcgatctgtttgaaaacagcataacctttattgacgttatagacaccttttaaggttgcagtgtctgagccaacccggtaagtttcattcgaatcaggttttaccagaatgtctccggcagtaacattctcactgtcgatatagtaataatcgtcagttgtgtaataaatcgttggcgaaacaaactctgttgttgtctttccgtttttgtttgtggacgaaacaagcagtccatcggcatcagaatccccgcctttcataaagtagctgaccggtatggtaaaaaattctttttctgtaattgccgaatttggaattttcagtccggtctgttcggtaagcagcagttcaatctctataaaacgatcttttgcgtaacgtaccagtgaattgcgaagtgttaaaatcaggtatttttcgccgctcttttctgtaatcacataggtagcgtatgccgttttaccatccttattaaaccggagttttaaagtattgtcatctgcaagttcatctgcgagtgtatttgtaataggaacgacaatatgccattcttcgttgctgatcagtttataaaccgcatccccgttagaaacggatacattctgttttaaattattgcgctgataggacgcttcatcaaactgttcttttgaaaaattgtccgtggtcgtattttcaaatccatccgtgtaataaacaaggatcccaggtgtatcggttgtgatcgtatgaaaggaagaaccatttccggcagcggatgtataatccgataatccgtttaaagcttccagacttaaggcttcatttaatgcagaatcaatattttctttaaatgaataaatattataaaatgtctgcgcctgataggaattttcatagtcggaaatatcattttcgatttctaaaagtccttcggcatccagattagaggcgtctgcacttacatcattaatcttttgggaaacgcttccgctttcatcgacggaacagatcagatctccgtatccgactctcgatgattcgcgtacataatagttcagtgatccagcgtattgcgatgtgacaattgtttcatcccgaaggatcagaccgcggtaaacattattttctgccatggttccctgctccacttcataaacagaagtatgcgttgttgtaatgtaagtgaaaacattgaatacaagatatatgaaaataataataaaaatgattacaccaatatttatgttgaacggtttacgatattttactacttttttatgttcattcaaaaatttactcacctcttaaatttttcaacattcctattctaacattttattcaatagaaaacaacgaggataaaaaagttttatacgaataaaaaattttttttgcgtgcatactatctgcaaaaggaggctaaaaaaatgaatacaaactggcttgattacacattgcttacattggttatcattggtgcgattaactggggactgattggctttttcaggtttgatctggtggcatttcttttcggggatatgtcatggcttacaagaattatttatgcacttgtgggaattgggggattatatctgctcagcttgttcggaagaatccgttctgtaggagaatcttaataacagaatgcatgtttcgcaaacattctgttatcatgaattatgcggtatggataagagatctttccataccgcataattcataacaaaagatatattcacatggtgtgtgttatctgattgtttacatattcatttttatagggaaatgacgatttttgcttttgcaatatctgtcagttttgattcatctttggatacgcttaaaatgaattttacattgtatttttcactgatcacatcaagcttttgaatcgcatgatttaaaagttcatcggaatctatcgatgcaatggtaagaaaactgtcaaggtacatttcttcaagatcgtgatcctgtgatatcacaccacagatgaaaccgagaaattcatcacagttatcaatcagaaaatcgttaacattgatcaatcgaatcttattatttaactcatacatatgtttctggctcttatccagatatacgatattgccagttgcagatgtgatcgatgtattgaccttgttaagcagttcctttgtctttccttttcccttttcgcctgaaataatctctatcatggtcatttccctcctgatccttcgatgcaacgtccatattcgtgaaaatgaataaaaacggttcgttttataaattaattatagtatattaacacaaaaaaaacaataatattttcaattaatttgcaaaaccggataacatttcattcattaacagataaaggtttgattttccgtctgctttcagaacaatagaaataattggctgtgactgttcattcatggaataaagcaccagacagtatcctgcatcaccggttgtacccgttttaccgccaattacggtaaaaccgtccggagattttgcgtgaccgctcagatactggtttgtattttcccaggtatgttcttctattgtaccatctcctgcctgataggttacatcataggaagtcgtgcttatgatctggacaaatgtttcattctgtaatgccgcacggaaaatcagatacagatcatatacagaggtataatgattttcatccggaagtccgtttgggttgacaaaatgagactgtgtcgcccccagtgcggctgcttctttgttcatcagtgccgcaaattcttccacactccctgaaatcgactctgcgattgcaatcgcagcatcattaccgcttcgcagcatcataccatataaaaggttatccatgcggatcacatctccggcatgaagaccgcagacagaggaatcggaggcctgatttgcagcgttttcactgatcgtgaccgtctggcttaaatctgtgcaatactttaatgcaatatatgcggtcagaatttttgttgtacttgccggatatagtctctcatatatattttttgcatagacaatctcatttgttgccagattaaaagtaccggcgccttctgcaacctgtgaatccgttgtatctgtaccaagtgaaacgtcatcggctacacacaggtcttttgaaaaatattcctgtgcaccggcagaaacagttgttccaagaccaagacttccggtcgtttcataaatatcataaggctgttccagtgtaacctcctctttgccacaaccggtaatgctgccaagtaaaaatcctgtaatacacagaacagatagcaatcgtttcatgttaaaattcctttcataaaatacgcaggatacaccagataaaggtatatcctgcgtatatattttattcttaataatagaatgttcacaaagtgtgtattctattattcgtttctgttatttgtacatttcacgccactctaaatcgcctctgtctaaagatttgatcagaagttctgcggtagcaagatttgttgcaagcggtatgttgtgtgtatcacagatttttacgacattgttgacatccggttcgtgtgattttggtgtcaacggatcacgaagaaaaatgacaagatcgatctcgttgtgctcgatctgagcccctaactgctgtgccccgcctaaatgtcctgccagatatttatgaacgtttaaatttgtaacctcttcgatcagtcttccggtcgttccagttgcataaagctcatttttgcaaagtataccccgataggcaatgcagaaattctgcatcagtttcttttttgaatcgtgtgctattaatccaatgttcatgttgtaggaccccctgttgttaatattttttcggctgaagcccgacatttaagacaagcccgatacctatatacaaagaccataatgatgtaagtccgtagctgacaaacggaagtgttacacctgtatttggcagaagcccgctcgccacaccgatattgacaaaagtctgaaaaccaatcagcgcacctacaccacaacagatcagtctgcctgctgtgtcttttgcttttctagcaataaatatacactcaatcgtgatgaaaagcaagagaattatgatcactgcactgcccacaaatccaagttcttcacctgcaaccgcgaaaataaagtcattttgaggttccaaaataaagtttccgtttttgaccgaagtcggatccgtattgttaagtccttttccccataatagtccggaaccgatcgccatgatcgaattctgctgctggtaggcaagatccggataatcgtccggataaagccatgccatgatacgccccagctgataagcgtggatgaatgggattttatcctgtatgatcagtgtcattccaatcagtccgaccggaatacatacgatcagcacaccgacgaccagtttgtaatttaagcctgccataaataataatgcgcaaaaaactaaggtaattacaatcattgtcgacagatttggctgtttatagattaaaaacagcggaatcgcaagtaacacaaacgaagaaacaatcactcttaccgtattgatcttctcctcatatttcatgaaataatacgcgaaaaataaaatcaaaagtatttttacaagttcggatggctgaaagcggataccgccaatctcaaaccagcgctgtgctccttttgaagaatcacccgcgacaagtaccagtgctaagagaccgactgccagcagatatatgatccaggaaaaacggaggataaaactgtaatcgatcaaagataaaatcaccatgatgacaataccgctcaccataccgatgatctgttttttctgatccccggggcttgcgctcccaaccagaaagacccccagggtatttaatatcagaacatatatgaccagtatgaatttgtaattctttagtttataaagtttagacattatcctactctcttttcttgtaatcctttaacattactttaatctcaatgttctccggctctataaccacatatttcgtgataacacagcctatctcctgacggatcagttccatagtggcatcatccagtttttgatggtctgcattcatcatcagctttaagcgctcttttgcaacatttccggaatgggttttaaacatgcagcgctcctttcacaggtttctttttaaaaaatatcttcgaaaaaatactgccctgttttatgtaatttaacagaggcacttcctcacctgtgattcgccgtgcaatattgttgtagcagagctcagaaagtaatgcattctttttatttccatccagatgcagcaacggttcgccatggttctgggcaatgatgatctgttcatcttccggcacgacaccaagtaatggcacatctaaaagttcacagatatcatcgatatttagcatatctccgtcttttaccatgtgcttgcgaaaaccattgatcagaagttctgtttttaccgtataatgtgtttttaatatctgaagtacacaatcagcatcatgaatggctgcaatctgaggtgttgtgaccactacaatgcggtcggctcccgtaatggcaagtaaaaatccctgatcgatacctgcgggactgtcaactaatatataatcaaattcctgtcttagatcatcaagcagatgtttcatctgatcagaatcaagcagaattttttcttttgtacaggatgacggtatcacagagagattcgggaatcgtttgtcccggatgattgcctgtttcgccctgcatctgccgcttagcacatccaccagattatagaggatccggttttccagtcccatgacaacatcaagatttcgtaagccgatatcagtatctaccaatacgacttttttatctaacagtgaaagtcctgcgccaacgttagctgtggttgtcgttttgccaacgccgccttttcctgaggtaaaagtaatcacttcacccatgagggaacctcctgttttgatttattaataaaacccgcaaaaaaacgggaattattcaaatgttaatcatttacaccatttgatgtagcattaatattctcagcctgtccgtttaacagagaatcagcatcttcaactttgaaatagtatgcaaggatcttctttgaaacttctgccgcattgtgggaagtatatccatttgcaatacgcgttgcaattgatatttcaggattatcgtacggagcataaccgacaaacaaagcgtggtttggccgtttcagatcctcctgtgccgtacctgtcttgccggctgcctcgattggaaatccatcgaattcttttgtattttcaaccaccatgcgtataccggtatgaatggcatcccagtcactgtcacttaagacatccacggtattgcgtatctccggttcgtattgttttaatgtgtttccgtcagaatccgttactttgtttaaaagtgtgtaattatatacggtaccactgtttgcaacggcagtaacatatctggcgagctgtatcgtggagtagttattattactctgaccaatggcagccatgacagggaaactatctgcgacctgcggtttgctctcttcaatttctatgccggttgtttcattcaggccataaagtgaagcatatttctgaattttttcaataccgttttctgcggcatcattattgtagctcattgcataattattggtactgagacggtaaccaacttcatagaagaagtagttacaggaatctctaagtgcttcagacacattaataagaccatgtgatccgtggaaagaacgataaatccagcatctcggttcattgcttacgtttttgtacactccaagatcctggatctgctccgtcgtactgatcacatgttctgcaagacctgccgtcgctgataccattttaaatgtagaaccaggtgccgtccgctgctgggttgcataattgtacagaggtcttgcattattttgctgcaggctgttgaagtaatcggaatcgacggtgtttgcaagcctgttaccgtcgtatccaggataacttaccaaagcgagaacttcccctgtctttgtatctgtgatcacacaggagcccgcacatggatctaaggcaagctgtgccggtgtaatttcaagattctggatcttttccttgataaaggaagccggtgcaattgtgccgcctgataatcctgcaatatcatcctcgtcaaatgccagaatattctgatcaaataagatcagacaaagctgtcttccggtaattgcatcggtctggattaaatattcatatataatttttgtaaaatctgaatctgtactgatatcatttagaatataatcacacaatgcatcatatatttcagtagaatctgaatatttttcacttacggaaaactttgtaatgtcgatccaccctttggcaattgcatggtttaaatactcctgcgggccaatcgccccattctgccattgaaggtaaacctcatcggacgtatcaatatttttctttaacaggatattgttatcatgaagcatattttttatgatataggtaaaataatcctgatattcctctgtcatcgatgcaaatggtgtcggtgcacttccggtcagttcggtgcgtatctgttcaattacagcattttgtctgctggcaaagatctgctgtacttcccgttccgtgggggatgcattttcttctgaaaaatgtgaaaaatcaatcacattattgttaatcagtgcaaaatagacatctgtgatcggaatattgatatctgatccaggattatcaatattggagtatacgattccggcaatctcctgctctaaaagcttatatactgcaatctgaagatctttgtcgatagacagatagacatcatttcctgcctgcggttcttcgtgttcaatgacttttaccgcttttccaagataatccacatagagcttttcatgacctttctcaccttttaaatcgctgtccatatactgttcaataccaagtttaccgactacgtcatttaaagtataggaatcatctgtctctgaaagtttattgtattcgtcggtggatatttttccggtgtaaccgataatggaagaaaaatattcactatcgttgtactttcgtatggtatcctctaatacttcaaccccctgcaattctgcagcgtgttcgctgatataggcaaccgactcctcggaaacgttcgttgcgatcgttgttgcaatatatttctgataggcattttgtgccatggaaaaacgtacaacagtaatcttatatgccattgcatcatcatattcggttccaatggcataacggttgctgcccgccagatattgcataacctgtgcagcggttgcttccgtcggtttaaaatcaagtttgttgcgggaaatgatgtcagattcatcttcctgcatactttcaaatgaagcctctccaaacacatctgccagaaaacgtttccaggttgcgccggattcttctatgttataactgtaattgccattgtcatccagcaatattttaaaatcgttgacaatggagtctccattttcttcaagtgcggttacgacctgtgcaatttctgcattgatcgctgcattttttgctttcgtagaactgtaagtaccattatcctcgatcgtaatggaatatgccagttcattgtaggcgagcaggttgccattgcggtcataaatatttccgcgtgtactgtttaaggtgcgttccttgacgattttgaacgtataattgtcctgatattcttttccatttacaatctgaagagaaaaaatacgccacagaagaatggaaaacagcagaatcatcacaactgttgctacaaccagccgcgatttaaaaaacatacggcatgcttcttttatattatcaaacaaatttgcttgcactccttttctcgattgcttccagtttctggtttatctttaaaattatgaaatacaaaaaaattgttataaccatggtataaaccaactctggtatcattaattgtaaaaaatagtagttaaagtcgtatctgtttcgaaaaagaaacataataaaataaatcagaaggttgcagcttaaatcactgcctgcaatcaggacaagcggcagtttaatatcttccggataaaaaagtttacggaacattccattgatataaccgatatacatatataagaggctgtaaaatccaagaacacctccaccgaaaatatctaagagcagtccgcagaaaaaaccgataaaaagtccttctttgcgtccacgcataaaaccaaaggacgatgttacgataatcagaaggtttggtgatatggatgcaaaggaaagtgtgtcaaaaaatgtcgtttgcaacagatagcagacgccaataataataaatacggtaatctttcttctcataaataacctctatttctaagattctgctgtctgtttcttatttaaaatgacaagaacttcttcgatatgctcaaaatcgactgccggtgtaatggtacccgactttgtaagattattagaatccatggtaagtgtactgatataaccgatcagaattccctgctgatagcggtttgatacataagaagtaacgacgggatcaccgatggcaactttattgtccttatcattgagatttgaaaattcaatgaccatattttcattcatattctgtaaactgccatttacgatcaggttatccgatgtggttgtaaccataccactgacttttatggtatcatttatgatagcagaaacttttgcatagtttggtcctacgtctgtgacaattcctacaagaccacttcccgcgatcacgttcatgtccacttcgattccatcgttagatcccttgtcaatcgtaaaattcgtaaaccagttgccgccgtcttttccgataacatttgctgcaactttatcgtaacttggatatttctgatccagttttaaaagttctcttaaattgtcaagctcgtactgctctaatttaatggtatttaattccgtggtcagatcatccacctgacgtttcaggtcttcattttctgccataacatcatttaatttttttagattgtctgctttttcaccaatccagctgccaacagaattaatgccgcgctgcattggaataaatacatatccggcgacagtatttaatggtccgccggatatgccgagtgtaaaactgagtaatattgccacaatacatacaccgcttaagataagcaatatatattttgtgggaagaacaaattttggttttcgtttcatactttcccctaaatcaagatcttacttttcatgctgaaggcaagatgtttgtatttgctgtcggaaacaatttttacaagaccacgcacaacgcactcttccggttcttcacaggtattgatatcaattcctgtgatatctgcaaacaatttatccagatcatgaatctgggaacttccgcctgtgatatagattccggaatggataatatcttttgcaagttccggtggtgttttctctaagatcattttgatggaattgcagatactttcgagattatctttgattgcttcatagacaactccgcctgacatttccatttcgatcggaagtccgcttacaacatctctgccgacaacgatcatcgtatcttcattgcccgggataccggaacccaaacgttctttcatactctgtgccgttttctgcccgatcaccagattataatttcgttttacataagtaatgatggattcatcaatcttattgccgccaaaatggagaagatcactaagtacaagtcctccaagtgaaataacagaaatctcggtcgtatctgcaccgatatctacaaccatgataccggtcggttcattgacgtctaatcccaatcccacagcatctgcgattggtttttcacataaaagaacactctttggtttcatcttgctcttatagaacatgtcaaaaaacgcttttttctctacttctgtgatacttgtcggtactgccacaataaattctgccccctttaagcttcccttgacatgtgtttctaagaaaagctgtatcatggactgaagattgttgaaatctgcgatgacacctgttgtaacagggaatgtcacatggatagactccggggccttttcatacattgcgtatgccgagttaccataagcgtagatctcatctttattttttaatgcgatcgtgtttttctcatttaagattttgttggaagacttgcagtaaattttcatattgcatgttccaagatcaataccgtatacgttgtttgtcattgttctctccctttggaacgcggtttaaaccacgatcctgttattttctctgtaactaaagtaagaatgatctccgataataacatggtcggaaagcggaatgcccatcaactgtccgcagtttaaaatccgttttgtaacgacatcatctgcatgggatggttccggtataccgctcggatgattatggactaagataagatgtgctgcatgacagttgattgctgtttcaaaaacctcacgcggcgaaacaatcgtctcgtttgcactgccgacagaaagcagtttatcacctttcatgtggcatttgttgtcgaacatacagacgatcagatgttctttgttctcgtggcgcagatgctccatatagtaatctgcgatggttctcggattagtcatgcatacgtttggtgctgattttgtctgtgcaatccgctttgataattccgcaatacattttaactggattgcctttatgggaccaattccacgtattttctgcatcttttcaaacggaatgtcatagaggtttaacaaattgcgatgaccgtcatttaacagattctgcgcaacttccacagacttcagaccgcttgtccctgaacggataatcactgctaacagctctgcatcacttaagtattccggaccatatgtaagaaacttttcatatggcttttccgaatccggcaattcttttaccgtagtaattttgttcataaatgcttcctctctgctctcccgggaagcatacataaatcacattatattctatcataacaagtcaaggtcgacaagttttcgttccttaagtttttgtaaagatttgagaatgcccagttttgcgtgataccaggtcagtccgccctggaaataaacggcatatggaggcttgatcggaccgtctgcactcagctcaatggatgatccctgtacaaaagcacctgccgccatgatgacatcgctgtcatagcccggcattgcccacggttccggcgttacatagctgtcgaccggtgccgccgcctgaattccctcacagaatgcaatcagtgcatccggattgtggaatgcgaccgcctgaatgatatcgtgacggctctcacttccgttcggaacaacctcaaatccaagtttttcgtaaatatttgccgcgaagatcgcaccctttaatgcgccgctcaccacggtcggtgcaaggaaaaatccctgataaaaagactggatgacacctaaggatgcaccgacttcttttccgagtcccggagaggtcagacggtaagcagcattttcgacacattcttttttcccgacaatatatccgccaatcggcgcaagtccgccgcccgggtttttaatcagagaaccaacgatcatgtccgctccgacttcaagcggttcctgctcttcgacaaattcaccgtaacagttatctaccatacagatgacatccggtttgatgcctttgatgtaggagatcagctctccaatacgtgccacggacagggttggtctggttgcataccctttggagcgctggatcgtcacgagttttgtccgctcattgatcgcctctttgatatgttcaaaatcaaaacttccgtccggcagaagatccacctgacggtaagacacgccgtattctgccagagatccctttgacggacggatgccgatcacttcctctaaggtgtcatatggttttccgaccggggataaaagttcatctcccggacgaaggtttgacattaaagcaagtgctaaagcgtgtgtgccgcaggtaatctgcggacgtactaaagcatcttctcctttaaagcaggatgcatatactttttctaatgtgtcacgtccgaggtcgttgtagccgtatcctgatgacatattaaagcactctgcactcacacggttgtcctgcatcgctttgatgacttttaactggttgtattctgccgtagcatcgatcgctgcaaaacgttcttttaaggaatcttcgattttttctccaaattcatatacttctcttgaaataccaagggcttcgtattgttcttccatccacttattcatgactgattatttccttttcttctaaaattgatatcatatctgttaaaatcgctgcatcatcatagccaaatgcctgcttgtcgagccagatcacatcccgctctctcttaaaccatgtcaactggcgttttgcaaagtggcgcgtctcacgcttgatgatatagacagcttcctctaaggtacacccgccgtctaaatatgcaaggatctccttgtagccgagcccctgcatggaaaccatctcccggctgcagcccatggattttaatttttttacttcctccacaagtccggcttctatcattgcatccacgcgtctgtcaatgcgttcgtacaattttgcacgctcatccgtgagtacaaaataggcaaaattgtatggagactgtttttgtcgttccgtttcgttgtgctcagatatttttttgccggacaaatgataaaattctaacgcccttatcacacgtttgatattattggcatggatcgcttcggcggaagctggatccacttcgcgcagtattccgtgcagatattctgcgccatgttctctggcaagatcttctaactgcctgcggtaagtctcatcacactgctgctctgtaaaatcaatatcatacaaaagtgcctgaatgtaaaatccggtgcccccggctatgatcgggatttttccatccgcatagatttcttttaaatattcttttgccatcgtgacaaaacgcacaacgtgaaattcttcgtccggctctagctcatcgatcatataatgcgtaacaccctgcatctcctccggtgtgatcttggcagaaccgatatccatatggcggtagacctgcatagaatccgcagagatcaccgctccatttattttttttgccagttccaccgagagggcacttttccccaccgcggtcggaccggtcagaataatcattggtttttgctgcatatcagacaatccttttaaatttcttttctatttcatatttggtcatggaaatgatcgtcgggcgtccgtgcgggcagttgtacggattttcaagctccaacagttcatcgatcagccgttctgcctccggcctgctgatgtgctggtttcccttgatagctgccttacaggacatcgacgcaactttttccataatggcatttggtgaatcattttcatttatatttgcaaaatcatctaacatttcaagaaacattgtttttgtgtcaatcccggtaaaatcagccggaatagcagtcactgcatattcctttccgccgaacggttcgatttcatagccgaacgcatcgatctgctccctgtatttttcaagcatctcgatctcttcaatgctgagtgtcaggatgatcggcggactgagcgtctgtgatgaaaatgttttttcacgcacttttttcatcgttttctcataaagtactttttcatgcgctgcatgctggtcgatgatgaacagcttgtcctcatactctaccatccagtaagtatcgaacagctgtccgatgatcttgtgtttcttcttggcatcttttgtcagaaacccttcggagactgccgcaagttcctgttgctcgtaagtgacttttgactccggtaaagctgccgctgtctcttctggcaggcttgccgttgttttatccgcctgtattggctgcggtacgggtttggaaacggtgtatgtattgctttccgatacccgatccgcggactgttctgtgacagccgtttctttctttggaagaagcgagttaaagacagaaaggttttccggcggtgctgattccttctgcggtgctgcgctctgcatcggaattgttgtctgcacgtcttcattttcttttgacgcagcgaaaccagactgtccgcctgttccctgctgtatgttctgcggctgaaaccttcctccactccgcaccgtttcaacaccccggcgctcaaacggttccgggagcggtgccttgatgttttcccgtttccgtatcttttcttcctgcaccggtacttcagggataaaatctttgtgcgtcagtgcgccccggataatttcaaacaatgtcttatagatcgcctcattgtttgaaaaacggagttccatcttcgtcggatgcacgttgacatctaaaagatcggtatccatggaaaagtacagaacgcagaacggatactggtgctgcatcagaaagcctttgtacgcttcctcaatcgactttgagagcagcgcgctcttgatataacgtccgttgataaagtaattctcaaaattacggtttccgcgggaaattaacggttttccgataaaacccttgacatgaaaatactcatttttatggtcgatctctaaaagcccggaggtgatatccctgccgtagatatgatagatcatatctttttccctggaattgccggaggtatgcattttcgtctgaccgttattgataaatttaaaggaaacccccggatgtgacagggcaagacgctccatcaggtcattgatataattgccctccgtctgcgcggtctttaaaaatttgcgcctcgccggtgtattgtaaaaaagattgcggacgataaaagtggttccctccggcgcaccgatctcctcattttccttttctttcgaaccctcaataacatagcgggtaccggtcagctccccgtatgtttttgtgatcagctcgacctgtgaaactgcagcgatacttgagagcgcctcaccgcggaatcccaaagaggtaatgctcatcagatcttccacgcttttgatcttgctggtcgaatggcgcaaaaaggcaagcggaacctgcgccctctcgatgccgcagccattgtccgtgatacggataaatgaaataccgccctctttgatctcaactgtgacggcagttgcctttgcatcgatggcattttccaccagttcttttaccacggaagaggggcgttccacaacttccccggctgcaatcttgtcaattgtctcctgactgagcagtgtaatttcaggcatacagattcacctctttgtttcaatcgtttctgctgcatttcctgcagcattattctgttatggtcttggcatcttaggaacgccggacaccggtttcccgcaaggtcttgtctcggagcagtatccgaagtaatcacattttggcataaacagattatctgcgatccagcgccattcttccgaatattccgaaagtgcttttcggatgtcaccaaataactggcggtattcccaatatgcacggttacacattctctgatggctcatctccgttaaactgcgcagatttcttttatccacgatcgacgccgtcatgccaagcggcagtccgtttgcaacatcttcctttggaatcccgtagtcttcctgcaaagcgcggcattcttcattgatatgcgccattaatgcctgatatttttccaatgcttctttgttgttctggatcgacggcgggatgatgtaatcaaatccgcgtccggcataattgatatagcgtgtacttgactgtaaacgtgtcggtgagccgccaatatgtgtataccactcgcgctctactctcgcggaatagccggcaatgatcatctctacatttacatattccatgactcttccatgtccggaaatgatacagtccatgccccgtttataatttttctccggatcttctacatttcctccccagcagacaccggcgcgctgtcccatcagcgtgatcgggtttttagttgtctccggcaaaattgtaattgtgcccataaattttattctccatttctaccagcggttttttattttattctgtaattcataaagtttgtttaatgcctcgatcggtgtcagatttccgacatcaatcgtttttaactcttctaaaatatcatcgtcctttacggtatcaaataaagacatctgtgtcaaatcaacttcatccaaacgttcttttttctttttcgttcctgccgttgcaggcgtgatgtttttcgtgacagacgtgatatcatttgcgctcagctcttccacgatttctttggcgcgttcaatcacggaatccggaacaccggcaagttttgcaacctggataccgtagctcttatccgcaccgccctgcacgatcttgcgcagaaatacaatgtcgtcgcctttttctttgaccgcgatacagtaattgtggacgttgtttaactttccttccagctcagtcagctcgtgataatgtgtcgcaaacagtgtctttgcaccgagcagacgcgggttgctgatatgttcaactaccgcccatgcgatacttaaaccgtcaaaggtacttgttccgcgtccgatttcatcgagtactaaaagcgaattggatgtggcattgcgcaggatatttgcgacctcgttcatctccaccataaaggtactctgaccgcttgcaagatcatccgatgccccgacacgggtaaaaatacgatccacgatgccgatctttgccgatgtcgctggaacaaaacttccgatctgtgccatcagaacgatcaatgcagcctgtctcatgtaagtggatttgcctgccatgttcggtccggttatgattgcaatacggttatttccgttatctaaatatgtatcgttatcgatgaacatatcgtttgtgatcattttttcgacaaccggatgtctgccgcccttgatatcgatcactccactgttggtcatctttggtctgcagtaattattctggtctgcaacgactgcaagtgatacaaaaacgtctaagtttgcgattgctttcgctgtccgctggatacggacaacttcttctgcaattttattccgtacttcacagaacagatcatactctaagctgacgagcttgtcctccgcgcctaagatcatatcttctaattcttttaattccggtgtgatgtaacgctccgcattggcaagtgtctgttttctggtaaaataatccggcaccagatccttgtaggaattggtcacttccagataataaccgaacactttgttgtatttgatctttaaatttttaattccggtcttttcgcgctcttttgcctctaactctgcaagccaggtcttaccctctgttttggcattgcggtatttatcgacatcctcattataaccttccttgatcagtccgccctcgcgcacagagatcggcggttcttccatgatcgaacgatctaccagggagcagagttcttccatggcatcaatgtcgttctggatattttttagcagtgcaccgtcaaactcatcgagcagggatttgatcggaggcagcatgctgatagaattcttaaatgcgatcagatcacgcggattggctgtccggtaagtcacacgggtgatcagacgctcaaggtcataaatcggatttaaatactcgcgcaattcctcccttgtgatcacatgatcgtttaactcaccaatggcttcctggcgcagttcaatctcggttttatcgatcaatggctgttccacataagcacgaagtgtccttgctcccatcgctgttttggttttatctaacacccatagcagtgaaccgcgtttttgcttttcacgcagtgtctccaccagctctaaattacgtctggtcgaactgtctatgatcatatatttcccggttgagtatggatgaatcgcagaaagattgccaagatcatttttctgtgtttcatacagatagcggagcaatgcccccgcagcgatcgtgccgcacgcataatcagataatccaagcccctcaagactctgcaccttaaaatgttcttttaacgtattttctgccgtctcgtcactgaaataccatgcctctaaagagtacactgcaataccaaggcgatttttcatatcagagagatcgacaccgctcatataaaagctctcattgcagatgatctcggatggtgcaaatttgttgatctcgtcaatcagtttccgctccgtatcgacctctgtaacaaaatagtctccggtcgagatgtccgctaatgaaataccgtatttatctgcaagatatacgatacacataatgtaattatttttggattcgtcgagagcctgcatgtctgtgtttgttcccggtgtgacgatgcggatcacctcacgctttacaagaccttttgcaagttttggatcctccacctgctcacagatcgcaactttatgaccgtttgcaaccagtttatttaagtatccttccactgcatgataaggaacaccgcacatcggcgcgcgttcctctgcaccacagcttttgccggtcagcgtcagttcaagttcttttgagacaacgatcgcatcatcaaaaaacatctcataaaaatcaccgagtctgtaaaacaaaatgcaatctttatattcctcttttgtttttaaatattgctgcatcataggtgtatattctgccacgtctttaacctctgttctttttctattcatcataatagcgtccgtcaaatggatcatctatttttttcataattgtaatctatcatttactctctatggcatatctaccgattgcctcggcaacctttaagccgtccattgccgcagacatgataccacctgcatatccggcgccttccccgcatgggtaaatgccgcggatattcgactggaatgattcatcacgcacgatacgcaccggggaagatgtacggctttcgacaccggaaaggatcgcatcctcacggtcaaattccggaatcgcacgggaaaaatgatgcattccttctatgaatgattcctctaattcttccggcagaagtcctctcaaattacaaagtacggaatcaccctttgttgtactctcaaatgcaccgtaggaaacggaaggacgatttttacagtaatcaccaaacaactgctgtgggatctttccatttccaagtttccatgcccgctcctccagacgttcctgaaaacggacgccggacagtacatcttctttcccatcggcatcttttaaaacaccatgacggatcgcatccgccttaaaatcttccggtgtgacggagacgatgatcgcactgtttgcgttgctgccgccacggtccgagtaactcatgccgttgactgcaaggcggtgttcttcggaggaagcgtttacgacataaccgcccggacacatgcaaaaggagtatacccctctgccggagggaagatttgccgtcactttataaggtgccgcaggaagtttgtctgcatataaatctccgtactgtgtcagattgacctcgctctgcggatgctccacacggaatccgaccgcaaaggattttgcctgcatatttaagcccttttcctgtaacagcgaaaacgtatcccttgcactgtgaccgatggcaaggatcaggcagtcggtatcgatctgtctgtcgtgatttaattcgatagattttaagttcccgtttttgccggtggaaaatccagtaacacaggtctcaaataaaaactctacgccattttctgtcataaattcccgcatccgttttatcacatctgcaagaatgtctgtgccgatatgtggtttgttttcatataaaatatgttccggtgccccaaattttacgaatgtttcaagaacaaaacggttccttccaatgggatctttgaccaatgtatttaattttccatcggaaaaggttcctgcaccgccctctccgaactggacgttcgaggcggtgtctaagacaccggtctcccagaacttctgcacatccgcagtccgttcttcgacctttttaccacgctctgccacgatcggatgaaaaccctctgacattaatgcataggcacagaacagtccggcagggcctgcccccgcgatcacaggtgtgcgtgaaggatttatgacttccggaaggaggtattttttcactttgattgacataacattattattgttaaccttttttaaaattttctggtcgtctgccgtctctacatctacggagtacacataaaacagatccggcttcttccttgcgtcaatggattttttgacgatctggtattgaaaaggcgtgtctgcctttaatttcaacgcttttttgatcttttgctctaactgcaccgtatcatgtgttactggcagcttgatctgattaattcgaatcataatttcctcgtttcttcctgtgcgcttttttccccggatgtgcatattctcctgcgtggcttcctgccacatatccgctggaccaagcccattgcagattatatccaccgcagataccatcaatatcaacgacttctcctgcgaaaaacagtcccggaattaattttgacatcatgctggctgcatcgatctcgcgtgtgtccacaccgcccgcacagacctgtgcctgcgcgatatctttgcttcctgtgatgtcgacacgcaggtctttcagcagttttgtcagacgtgtcaattgtttttccggtactttttttgacggaatatgaagatcaatcccggcttcttttaagagtacctctgcaagctttttattgcagagaccgatcatcgcctgagaggcatcttttccgtgagcattcatgcaaaaacgcagtttcagcagatcattcacttccccaaaagaccggtccggcataaaatcgatctgtgcatatacctgttttttctgttttaaagctctggttgcatatcggctgatctgaaaaaccggaattcccgatattccataatccgtcagctgtaattcaccacgttctctggtcgtttctgctccgtttatgtacagtcttatcgaaacttctgcacggattcctgcaagcattttaaagaatgactgcctgcactgcaacggcaccaacgccggtacaatatctatgatatggtgcccaaagtgttcaatatatggaagcgcactgccgtcactcccactcttcggcgaagcaaaaagaccggttgcaaaaatgattgattttgcgcgaaaatctcctgtgcctgtccggatcagaaagaaatccccctgtctttttattgctttgatctcacaggagacaatctcctttacaccggtatatgcggcttccatgcgaaggacatccagaacagaagcagcctgttcacttgccgggtaataatagccgttttttatttttggttcgataccgatctcacgaaaaaacgccactgtttttttctgatcgaactgtctgaataccggtacagcaaaagcaggattttcgcctctgtaacacgataatccctgcacctcgtttgtataattacattttccattccccgtggcaagtattttcttacctacacggtccatatgttctaagatgattgtatctgcacctgctaaagcagacgcaatagaagccatcagcccggatgctccgccgccaatgactgcaacttctgtttctgtcatattaaaaacctttttcgatatttatatagtttatttgtccgtaacaggataaaccattgattattttaacatacaaaaaacaaacattcaatccgtgaaacccatagttattgctggtaattcatcaatatcagaaaggctgcagtaatctaactggaatagctctccaaaaaggcgtacaattcctgatcgtccgaaaaccggatcccattttccaatttttttaccatatcttcattcagatcacggatgcggatatttgtctcaaaaaattctgtgatcccatcactctggtatacgaccaatatcccgtccttctgttttataacatatgcatatgattcataaacagcaagactctctgttgtcttaagttctttttctgtatccgtttctgccggcatttcttcggttgccgcagcaagatcctgttctttttcccccgtatcctgttgtgtaaacagtaaataaacaaccatgaccaataaaagaaagatcattccggtaaaaaggcaaatactcgtcgtttttttcatcccatcactccatattccggttttacgataagtatttgccaaattttactttttattcacttgtcagaaatattttttcatggttatagaatgtctaaacacatgccgtcagctattttaataagtgcattttttttgcgacatctgccagcatgcggcctttcggaaaacgcaagatttcctgctcatttaatccttttaacagcaacagtaacactgcatataccgccgctccaatcacgatcgacaaaagcgttgctacagcattaacacgcagcacgtacagaatgccatgatagacgagccatacaacaacacccataccggcagcggcgattgcagggacaaaaaatgtttttcgaatttcctgatgatatccgctgtaacggcggattgatcctgcatttaaaatacacatgataagaccgaatgctgcatttgcgataacgactgcaaaaatgtttaagtcaaacaagaacataagtgctgccagcagtcctaaatgcagtaccagtgcaatgatcgcatttttgatcggttctttcatgcggccgattccctgtaaaagaccgtttgaaagcgttgacagtgaaaaaaacaaaatcgtaacagctcctacctgtaacatatgtgcagcagtctccgatgaatcacggaacaaaagctgtaagatcggtgatgcaagtatgcccatgccaactgcacatggaaaagcaatcaccatgataaaacgtgttgcaatcccgatctgtcgttttgcttcgccttttttcccggctgcataggcagcagtcagtgcaggaacagaggatgccgccatcgctgatgcaatggagatcggaacattgatcagaaccgtatattttccagtataaataccattccaggaaccatactggttcgcggtatatccctgatatgcagcaatgtgtttatatacagcctgatctatgacggtattgcagttgtagatcgtactgctcagtaaaaccgggatgatcgttatgataagcagatgaaatatcgagccataggaatcaacgtttcttttccgctctctgtgcagactgcgtttgaacgcacacagatatacaaccagtacaaaggtacagaataataatgcaaccagtgctccgatcgcagtaccaagcgttcctcctgctgctccgtatgctgcggaataattatcagcatcaccaagcagtgctccagcctttgcaccataatcagccaatacatacgctgcccatacactgacgattgcatttgcaatctgctctaagatctgggaagttgcactcggcatcattgttccaagtccctgaaaaaatcctctcataacaccaagtactgcaacaatcagaagtacagggatcagtacacgcacagcgaagacgctcatcggtgttttcatcagcgtgcctgtgataaactcagcaccaaacaaaaggatcagtgcggcgaccgtaccggtacatacaccgaagatcaatgcacattttaaaatgcggtatacattgtgtcttctgccctgtgaataatttgcagatacaagttttgatactgcgagcggcagactgtaggatgaaatgatcaataatatattataaatctggaaagcagttccatagtagtcatttccggtatccccgataatatttgtcagcgggatacggtagatcagaccgataatacggctgacgatggatgcgatagcaagaatagaaccctgcacaagaaaacttgtactgctttttttattttgtttgcccatatgacttaatcctcgttatcttaaaatgttcatctcgtttaagatctcagtttgttttccctccataatggcagcttcctccggtgtcatatggtcatatccaaataaatgaagcatactgtgaaggattaaaaatgcatattcacgtttttcactgtgcccataactttttgcctgttcctttactttgtcaacagagataatgatatcaccgagcattatttcgcctgtgtccgggttgaaattgtcatcgtaatcatcttctaatttcgaaaaatctcctgcgctctcataagaaagcatcggaaatgacaaaacgtccgtcggcgcatcaatgtcacggtattctttattgatggcgtggattccatcattgtccgtgagcgtcagattgatttcagcttcaaacggaaatccctcatgctcgattgcatagtctgtcacttcttttgcaagtgcctcctcatcaaatgaaaaatcagtatctgtttctttttctataaaaagactcataaatttcctcatttctgtgccttacaggcagtttttatatcttttgtattttatacgttttttaaaagaagaaggtttcttcatttacaagatattccctgatctttaaaaacatattcatgccgagcccggactgatcataaattccgcttgcagaatattcgtttagtgtctggtagatgaccatatcctgattccattcgcttgccattgtataactgtcaaaaacttctatctttttgaccaggccatttaccatatgtacgatcgcggactcgatggatgaaggcggtgctgtttcgccatcatattcactgatgatacggatgacatcttccgggaaacagtgttcctgtgcaatgcggattccgctctctgtgagcggttcaccttccatgatcccgatccggtaataaaatcctgccgccgcgcaggtcttttcatctgccccggcaactctcgcacagcttgctgcaagtcttgaaactctgcgtgcatgctgatattcctgtttcgaaaaatttgacagttcacggacaagaggataagtatcatctataatatccgtcaggatatcatttacttcctgttccctcaaatgtgagaaatgcggatagccaaactgcagccacaaaacactgatggcaccctctccaattccccataataaaagcacaaaatgtacctcctgataggtcagataataaaaggtgactggaagtaaaacggagaggcagaacaacagcacttcataccagataagttttttcccctgttttgcggcttcctccgccgtcccggcaaggatcacaccaaagattgtcaacagacagtacaatatcagttcctgtgaatgcagtcccataaccagacatatcatggaatcccagaaaataccggtaataagcgcaagacgttcggaaacaaaggctgcaataatgagcggtacaaataccagcggttttacaaatccaggaaagtatgatgcaaacacaaccaccaccgctgctgccgtataactatataatacttttttgaaatctgtttcacggttatggctgatcagtccttccgcacgatcgtgttctataaagaaaagaaacaatacaaaccatatcatggcaacacagacaatccctaaaatctgatccagtaaaatctgttgttttgcacacagtaaaagtatggctgcaatggtaacgataaacatgcagacctgattccatcctcttttgattacaaagcggtcattcatcgctggcgagtctcctgttttctttttgatgcgctcttactgcggttttcataatcttcataagccttcacgatcttctgtacaaccggatgacggaccacatctttgctggtcagttcacagatgccgatctcatccactttttttaatacttttaaggcaacatcaagaccggatgctgtgccaggtgctaaatccttctgggttgcatcaccggtaatcaccgccttagatccaaaaccgatacgggtaaggaacattttcatctgcgccggtgtggtgttctgcgcctcatctaatatgataaatgcgttgtcaagtgtacgtccgcgcatgtatgcaagcggtgcaacctcgatcagccccttttccatatttttctggaagctttctgctcccatgatctgatataatgcatcataaagcggtcttaaatacgggtcgaccttactctgtaaatcccccggcaaaaatcctaatttctcgccggcttcgattgccggacgtgtcaggatgatccttcctacttcttcattcttaaacgccgtgatcgccattgccattgcaagataagttttaccggttcctgcaggacccatgccaaacacgatcattttctggcgtatcgcatccacatatgctttctgtccaagtgtctttggtttgaccggcttgccgttgatcgtatggcagatacagtccttatcgatctccacgattgcggattctttttcttcctccgaaagtgccagtgcataattgacattctgctcagtaatgatattgcctctttttgataattcgatcagctgtaaaaatacctgttccgctttttttaaattatgttcctctccaaggagcttcatactctcaccgcgtaaaaccacagtgacgtttaaggtgcgttcaatttttttgatatacgcatcaaactgaccaaatacattggccacatgatcagtcggtatatttaatgatagttcagtcagactcatccgtcggttgcctctcttcgctcgattgttcgatgatttttgtcggctgataggaaacaatggattttaaagtgccaatcgttcctttcaccacatattttttcttcgttctctctataataacatttttttctgtaatttgaatacctttttcttccaaatcgtcaagatatttcttaagattctcagaagccagtcgttttgcctccttttctgtgtacgtcttttgttcatttttatagcccacacaggtctgtctgaccagataaaccggaagataaaaattatctgtaaagtgaaattgtgacacatccgacacaacttcatatggttcttccaccggtgaaaaaaaaggatttttgatcagataatccagaattctgacctgataagttattttttctgcgccggtcggcacttttttttcatattccatcggtatctcatcatggtaggaatatgtaacttttgcaatgacatctgcatctgcagtgcggtaaagatattgtgccgtctctccgtcatcatttagaatctcaacatacccattgactaacacatctccctttttcaccggggttcctacagtcactgccggtgtaccacttcttgtgatcatttctgtgatcaagccatcatcggcagcaacgatatcgtgcgctgtctcctctttcttttcctcataattttcttccgggagcagattttcctggatatcaaccgtcattttggtgccgtagattttgatggaagtccagatcacttcgggataacggcttcttaacgtttcctctaaagccgcacagtcaatattttttttctttgtgccaaaagaggcatgttctttcgaaagaaagcagagtacgacttcctcagacagataggaattgccgttgacttcaatattccagataaaaccggaaaggtaatagatcagccctgcaaataacagcatgcccatggcaaacattttccgtttgcggtaatggtacaattcaaacggcatgccatatcttttttggatgcggatatgtgttcttgtttttttaagatcggacgtaactgcttaaaacctgctacactgatgcagaattcgtatccatccttcgtagatttcaaattccagatcagaatatcatggcttccgcataaattcaggaaacgttccggcgcataaccgcttaaacggacatacacgtatcctttaaaatacttaattaccgagagcagcatctgttaattttcgtactggatcgtgtctaaaaacccggtaattttcatttcctcattcgtgtaatagtcgattgcaagatgtgagccggaaatcaggatcctgcagttttttgtctgtattttgataaaggaatcctcatattccaggattcctttataattagaaatcagaacctcatgccttccggttgcagtcacgatcgctgcgccgagcatcagatccttcggcagttctaagctgtttattattttttctttctgatttttcttcatatatgattgtatgaaggaaaaaaagatcttattctttattcgtaaatatattctcttacgaccggcagcatttctttcggcacggcagcaatttcataagcatgcagtactttttcggcagccgcatccattttttcacgatcatttgcataaatgactgccagtgtgtcaccggtatctacagcatctccatttttcttctttaaataaatgccaacagaaagatcgatcacactgtccttcgtttcacgtccaccgccaagtgtcatacaggcaatgccaatattttccgccagaatgcgatgcacgaatccgccgtacgctgcttttacttcgaccgaatattttgtttttgggaactttgaagtgtcatatacataagatgcatccccaccctgcgctctcacaaactcagccattttatcaagcgcagctccactgtctatggaatcctgcatgagttttaccgcctcttcgcatgaatctgcacgtcctgcaaagagtaacatctgggcccccagtgcaaagactacctctttaaaatccgaagggccttctccttttaaggtgtcgaccgcctcgatcacttcgatggcatttccaacggcatttccaagcggctggtccatatccgtgatgactgccgccgtctttttgcctgccatcgttccgatcgacaccatctcttttgcaagtgcgacagagtcttcatattttttcataaatgcgccgtttccggtcttgacgtcgagcacgattgcatcactgccggaagctaattttttgctcataatcgagctggcaatcagtgacatctgatcgacggtagccgtgacatcacgcagtgcgtacagctttttatccgccggggcaagattggccgtctgccctgccagtgcaataccgatctcacggacatttttaaaaaagatttcctccggaagcgcagtcgtaaatcccggaaaactctcaagtttgtcaatggttcctccggtatggccaagtcctcttccagacatctttgcaaccggaactccaagagaagcaatgatcggtgtcagcgctaacgatgtcttatctcccacaccgccggtactgtgtttatctactttcacacccggaatggaagagagatcgagcacatccccgctgtcacgcatggcaagtgtcaggtcgaccgtttcccgtttactcattccctgaaaacagatcgccatcgtcatggcagacatctgataatccggaatcgtaccgtccgtaaaaccatcgatcataaaacggatctcatctgtggtcagttccatgccaagttttttcttttcaatcaggtcatacattctcatgtgcataatcctcccttgtatcgatatcaacaaaaaattccggcattaaaaccggataagagaaaacatcatccgggtgggaacggatcactattttaccgccgcactccccggtcagtgcaagcagttccccgcgataagtttccgaaaaaagattggggctgcgcagactgccgtcacacgctaaagctccgatcccttttttgctgtgaaaaaatgcatccagaaagtcaaggagtaattctgcttttacatacggctggtctgcctgaaaaaacatatcataggaaacagaaccacccgttgctgtcacgggataagtgacagatgtctctatgccttttcgaatgcttgaggcaattccgtcgttttgcgtaccttgattgcgcacgacgatgcagtcgattgcagacaattctttacacaactgctcaatttcatcgtatgcagtcacaacaatgatcttacacggataactgctcatattctgcaggcgcactaattctgtcagaccatgcaggaacaacggttttccatgaaattccgtaagcagtttattgctgccgaaccgccttgcgtatccggcagcaagatagatcagatttatctgtatcgtatcagatcaccttcattcccttcaggattttctcaggtgtgatcggcagttcattgatccagacaccggtcgcattgtaaactgcatctgcgattgccggagccggcgtgttgatgacgatctcaccgatcgattttgcaccgaaaggaccggtcggctcatagctgctgtcaaattccacacggatgcggtcggtatctaaacggcttggcactttatactgcatgaaggagttagaaagattctttcctctctcatcataccagatatcttcatacagtgtcataccgattccctgtaaaagaccaccctcagtctgtacccttgcaaggttggtgtttacaaccgttccacaatccacacaggcggtgtaatccaataactcgatagcacctgtttccgggtctgcttcgatctccgcacacgccgccataaatggtggcggtgataccggagagctgtgtgagtatgttacttccagtgagatctcattgttgcacatggatgcagttgcaatatcaaacagactcatttttgcgccgtccgactcatcgatgacattttctccgtcaaaagtgagtgccgaggcatctttgttcatgcgtactgctgcaagcgcgatgatgcgttcacgcagctgttcacaagccttcactgttgccattccggtcagataggtcgtactggacgcataagaaccggaatcatatggggaaatatctgtatcaacaccgtacacggaaatattatcgatcggtgtctctaacacatccgccgcaaactgggcaatgatcgtatcgcaccctgttcccatatcggtacagccgaccgtgatatgataagttccctcatcacttaattttaccgtgacagaaccgacgtcacagttggaaatggaagatccctgcattgccatggcaacgccgcgtgcacggatctttccatccggcatgacagtgcgcatgcctttttctttccatccgatcatatcagaagcctttagcagacattcctctaagcggcagctattcgcggtctcgccataataagctggcatcacatcgccctcatggatcatattcttctggcgaagcacgatcggatccatggaaagtctgtctgccaatttattgactgtggactccaccgcaaaaataccctgtgtggcaccgtaaccgcggtaagcgcctgcggacatccggtttgtatagactacctcatactggaaacggaatgcctccgtgtggtacatcgggatggatttgtggccgcttaatcccaccgtagtcggaccatgttcaccaaacgcccctgtatttgaaagtgtgtgcaggtcgatggcacggatcgttccatccgacattgcgccaagacgtacacggacttccatctcgtggcgcggtgaggatgcgatcatggattcctccctggtgtagatcatttttgcaggttttccggtcttccatgttacgatcgccggatatacttccgtgacaaccgtctgttttgcaccgaaacctccaccgatacgcggtttgatgacacgcacttttgccttggaaatatcgagtgcatttgcaacgattctccgcacatggaacgggatctgcgtggaactgagcacgatcagacggccataggtatccagataggtacaggtacggaaagtttccatcatgctctgctgcatggctttgacatggtaagtttcgtctaatacgatatcacagtccgcaatcacggcatccacatcaccctctccgtccacaccggacgcacagaggttccttttgttgtccgcacccaccgggcagagtgacttccagtcatcctccggatgtactaaaaccggattatccattgctgtatggaaatctaatacagcatctaaaacctcataagtcactttgatccgttttaatgccatatcgactgctttttcggtctctccggcaacgatcgcaaccggatcgccgacaaagcggacacgatcttctaatatataacggtcatacggactcggctccggataagtctgtcctgccatggtaaagcggcgttttggaacatctttgtaggtcagtacacagacaataccgtctactttttctgcaaggtctgtgcggatctccttgatcagtgcatgcgcatgcggacttctcagaacttttacgaccagacagtcctttggcgccacatcatccatataaaccggttttccggtcacaagcgccatcgcatcttttttcattacgggagcgttgacaaattttcccggttttcttaagttcgtactgctgttcatgcttttccctccattttaaacttcaggtattctttgactgcacgaagctggctctcatatccgctgcatctgcagagatttccggcaagatattccttcatatcctcctccgtcgggttttccaactcatcctccatcgcaagtacattcatgataaatcccggattgcagaagccgcactgctcgccgccctgttttgcgagataagtgccaaattcttttgcacgatcttccactccctctaaggttgtgatatgtgtaccgtctgcccttgccgctaacacggaacaggaaagcaccggtttgtggtcaatccacacggtacagagaccgcagtttgaggtctcacatcctctttttacactgtaacagccctctgaccggacaaattctaacagcggcagatctgctgctatctcgcgtgtgatttcacgctcattcagccatacatgtattttcatcttattgttcgttctccatttctgatattgtctttttataagcaaagactttcatacctttttacaccaatgcctgtcttttatttttccaaagaacagattgctctgcggatcagcacgccggcaacatgttctctgtaatcagctccagctctgcggttgctgccataagtaaactgatctgcgcaccaggttgcaagttcctttaccagtgcctcatctttttcaaatccttccggaagctgctttccaaaaccatccggttcaccggaaccgagcggcagctctaccaatctggcatgaaccggtcttgctccgatactcacatgcagactgccatcatattcagacactgcacaggcaaccaccggaaaatcggtagccgtattgcgctggcttaaataggcaatgcggatcggcttttttgccacatgcagagctactaaaatatcattatcatatggcatatcaataaattcttttaaggaaaccatacctgcatgataaagctctacctgggtatccattgccagaaatacggtcagtacatcggaaaaaccaaaacgtccgaaaatacttccacctacggttgcacagttgcggaactgtacaccgacaatatggcggacactttcacggatggctccgtctgtatatgcggcaagtcccgcatgtttttctatctcacgcagtgttgtcatggcaccgatgacaaactctgtatccgtctcggtgatctgatccagcccaagccctgacagatcgattgccgtcgcaattctccggtcaccgatcttcatccagacaccgcctgcgatgatcttattattctttttctgattcagctcatacgcttcttctaaactttctaccttgcggtattcattgatcgttaacattgattcctcctgtgtgtacgcataaaagggtgctatttatattatactgtacagaagtactgccgtcaaacgggaataagggaaaaccaaggacttttcccggaaaaccaaggactttttctggaaaactgtggtttcccgcaaaaaaatggacatattacgcaaactctcatttgcaatatgcccattctctaaataactcttattcttttctaataagtaaacaactgcgtccagtacggcgttctctgactatctgtacggtaaccgacaccaagcttcttaaagttcgggtttaagatattcgcacggtgcccttcactgttcatccatgcattcataactgcttccggtgttttctgaccccatgcgatattttccccggctccgcgataagtgataccaagatctgtgatcgccgttccaaaatttcttccatccggtctggtatgggaaaatgatttttcaatttcttttgaacgtgtcattgcggcagtcgcaactgtatcatcccatgtaagttccgttaagccggcctttttccgctctgtgttgaccagttttaaaacctgttttgcataggaattttccgttacatcatctttcggctgttcactgtctgtagtactgttcccacctgattcagtaccgcccggctgactttcttccggcttttctgatgtgtctggtttttctggtgtacccggcttttccgatgtgtctggtttctctgacgtatcaggtttttctgatgtatccggtgtctgctcttctttgtcgtcttctggaatttccggtatgcagtctcccggtaaaacgattgccggaaaacgatcacatatttttttcaatacatcattgatagaacctgtctcaacagagttccactgatttgttgtgcagtccttctcataaactgagatgttcacacggttagcggacgctgcctctaccggtgcagatatgctcatcgcaattccaagtgccgttgtaaatgctagtattgtctgtttcttcatgatattcctccatttgtaattttacattatgtaacagtttaaatatttcttatccatttcaaatatattacataattgttacaagcagaagaatatcataatttatactgccatccaaccggtaaaatctggaatttccggtattttttactccactcccatctttttacagacatcgttcagacaacagcggtcacaatacggttttgtccgcgccgtacatacttcacgtccatgatacacaaaacggtgacacagatcattcccttcctccggcggaatgatcttccagagtgccatctctacttttttgggttctttgattccatcgacaagaccaatacggtttgcaaggcggatacagtgtgtgtcagttacgattgcaggttttccaaagacatctcccatgatcaggttcgcactctttcttcccacacccggaagttttaaaagggcgtcaaaatcttccggcacatttccaccgtactgctcccataaaatcttcatacatgcactgatatcccgtgccttgctttttccaagtccgcacggtcttacaatttcttcaatttcttccaccggtgcttcggcaagtgctttcacatccggaaatttttcatataatttttctacaacgatatttacccttgcatcggtacactgtgccgccaagcggacactgaccagaagtttccacgcctggtcatattcgagactgcatccggcatccgggtattcttttttcagacgctcgatcacttctttggcaagttctttctttctcatggttagcctcacttccttattgtcttattacaaaatatattcccttaaacacatttattttaagcgttattcttgtctgttttcaggtatcacaagttttagcgcaggcaccaagcttgtgatacctgatattctatcataaaaccttacctgaaacaatgaaagcaatactggtcaaaattactttctcacttcctgcgctccataaatagatttatccccgttcaccagataagcaaaaatgcatacgatcagaaacggcaccatatcatttgctccaaatacttcaagtccgatcaacaccggcgcaagcagtgtgttcgttgcacctgcaaatacagctgcgtatccgagtgccgcacagtaaaccggcgaaatggaaagaattccccctaaaacaattccaagcgatgcaccaatggaaaataacggtgtaacctccccaccctgatatccgattgcaagagttaaaattgtcagcagcagttttaagatccagtcataagaataaatcattctgccagaaaatgctgccgagatcagattggttccaagtccgctgtatcttccgttgtaaagcagaaacaaaatcagtgctaacgggatggaaataacacctatcctgaaatatggatttttgattttttctccgaaaaacttttttgattttgcaagcagaaacgaaaacagccgtccggtcagtccaaaaatgattccaagcacaatgagccgggcagccataccagcatctgatatctcaagtgtatccttaagcggcacataaaatttttccagccccagtgtatgggaagtataagcagctatatatgaagcaatcagtgccggcagcagtgcttcatactgtatttttcctgcaacgatcacttccatggaaaaaaatacggctgtaagcggcgtctgaaacaaaccaccgaaccccgccgccataccggtgatcagcataacgcggctgtcttttggaagatgaaatctgcgcccaagtacatgtgataatgctgcaccgatctgcacggcgacgccttcgcggccggcacttcctccgaataaatgcgtgatccaggttccagacatgaccagaggaattaacaacaacggaatatcctctctttttttctgtcccgtctcaaatactaatgtcatcccctttaagcttgtctcgctgaaatgataatacagccatgtgatcaaaagaccagcaaacggcagaaacggtatcagatacaaataatggcctgtccgaaaatcagaaattgtcagtagtcctctgccaaatactgtatcaatgattccaaccagtacaccggttaaaatggcaagcaatacatatttcagagataaaacaatcgtttgtgatttgttttccatccgtttaatccttcgctgtgcaatttttttgcacaaacatcctttctttatctgattatttttcgaaatcacaaaaaaagctgatacccccgtgcagtctacacagaagtcatcagctaaatttagcggtttcgaattaatcgtgggagaacctcattcccgtttcatactttttttctgtaaaatatcatatctttcgcgctatgtcaataaaaaatattttacattacaactttattgtgatacagtattgcagtaatgtttcattcatgatatacttgcaaaaatttatatgaacagacaaaggagagttttgttatgacaggacagacaataggactgcttctcgtcatgatcatttatctgatcctgatggttggcattggtgtactctattccaaaaagaacaatgatgtttctgatttttatctgggtggccgtaaactcgggccgattgtaactgcaatgagtgcggaagcatctgacatgagcagctggcttttgatgggactgcccggtgttgcgtatctttccggttgtgctgaggccggctggactgcgatcgggcttgcaatcggtacctatctcaactggctgatcgttgcaaaacgcctgcgccgttatacccacaaagcaaacaattccatcacgctgccggcttttttcgaaaacagataccgtgataaaagccatgcactgatggcaatttctgcaattatgatcgtgattttctttgtgccgtataccgcttccggttttgctgcatgtggtaaattgttttctacactgtttggtgtttcctatcttccggcaatgattatcagcgcgatcgtcattgttttgtacaccactcttggtggattccttgccgcaagcatgacggatctgattcagagtatcatcatgacaattgcactctttatcgttgtaattttcggtatccacactgccggaggatttgatgccattattgcgaacgcaaaatccatgaacggatatttaagtcttttttcttcctatgaccctgcagccggcgcatccgttccatacaaaagtcttaccattgcatcaacacttgcatggggactcggatattttggcatgccgcatatcctgcttcgttttatgggaatcgaggatgagaacaaattaaaaacctccagaaggattgcatccgtatgggttgttatttccatgtttgttgccatttttatcggtattatcggttctgcaatgaccaaagccggtgcccttgcgttatttgagaattcggctcagtctgagacactgattgtcagaacagctgtccttttaagtaatcacggtgttttatccgttatcatggctggacttattcttgccggaatccttgcaagtaccatgtcaacttcggattcacagcttttggctgcatcctcatgtgtttcacaaaacctgttctgtgattgcatgggattaaagctttccaaaaaatcttccatgcttatggcaagacttacagttgttgtgatcgccattatcggtgttttccttgccagaaacccaaacagttctgtattccgcatcgtatctttcgcctgggcaggatttggtgcgactttcggtgctgtcatgctgttttcattattctggaaacgtaccaatcgaaatggtgcacttgccggaatgattgtcggtggcgttatggtatttatatggaaatatctgattgccccacttggaggcctgtttggaatttatgaactgcttccggcatttttatgttctgcagctgcgatcgttgttgtcagtcttttgactgcaccaccttcacaggagatcgttgatgagtttgagagtgtataacagattttaaaaaagatttattttatttcgatcgaatacatctaaaaaacggggattacatactatagtaacatgtaatccctgtttttttcatgataaaacactaaggtttacgctttaacctctgtttttcccctgtttccagcataaattcataaacagggccttacaatcttcatctttctccgggtttaccgcatacattcccatcacaacaccggtaaaacctcctgcaacttcagaagataagtattttgtacgtgcgcttccaagcagaatttcttttccgtccatcacgccataaaaatgatactgcgccggatcagataccacttttaaggtaacctctgcatcatccggcagttctatttcttttaccaccataatcgcatcccctatgcgcagacgtaagatcaatgtgcgcttcttctcatcacataaaacagccagatcataatgatgttcctcggacagataaaatgtgatacccgcttccggcgaattcccggaaagtccgacggtaagttctgtgtcaaactccgactggcggacgcctaaaaatgttggtgtttctgcatcatttaaggtaaaacgattgcccaaaagtgtcacactgtttttggcaaatgcataacattccttgtggtactcacgcagatggcaaaaacgctgcggctcattttttaatgtctcaaaagaaacatcataacgtccgtttatttcctgtgccgtggcatttaacggcatatccattacagattccacggttccatttacacctgcagtgaaccatccatcgttatcccaggtaaccggaactaaaaatacctcacgtcctaaatgatggaacggcatccagtcgctctggatccggaatcccagacataccataaaggtttccccataaggtgtggtgataagatcaccatgaccgattccctgtatatgattttcattaccacccagattccggttggtaagtaccggattttgggcatacgcttcaaatggtccataaggatcttttgaccttgcataagttaccatatggccatattccgtaccaccttctgcaaccatgagataataccagtccccaaaatgatacatatgcggtgattcaatataacggccgccgcttcccttccagatcggtctgctttctgtcagacgttttccggttgtgatatcgatctcacactggaaaatacagcctcttccatctgattcatccgttccattgctgataaaataaactttgtctccttcaaaatacaaagacggatcaataccgccctgatccacaaaaacgggatccgaccattcgctgtagatatcgtctgtatagacataaaaatttttctgataggtattgttgttggtaaccatatagaaccgtccgttatggaagcggatcgtcggtgcgaacaccccgccggaaccgggaacctgatataaattgacctggctttttctggtaaggcaatggccgatcggtttccagtttaacagatcatcgctttcaaataatggaacccccggaaaatattcaaacgaactgcaggcaagataatatttgccgtttgcactgcagatacttggatccgggtaaaaaccacggacaactggattttgtactctcatgtcgctcttctccttctgcagcattcctcaacagactgtttgattcaaatttctgtctgccgaactgcattatttatgatacggttcgccattcataatccggtaactgcggtaaacctgttctaacaggatcacacgcatgagctgatgcggaaatgtcattttcgaaaaactgagtttacagtcagcacgttttaacaggttttccgacattcccagtgatccgccgatcagaaacacgatctgactgattccggaagtcccaagattttcaatcttttttgataactccaccgaatcaaattccctgccgtcgattgcaagggcaaatacatatgcgccctcttttgcctccttatccagacgcatcagaattcgctcggtttctttttccctgatctgattttctacggtatcacttgcattttcgggcgtcttttcgtcggcaacctctataatatctaatttacagtaacggcttaaacgtttgctgtactctgcgatcgcatccctgtaaaacttttctttgatcttcccgacacataaaattgtaattttcatagttcctcacattttaaataaaaattatattgttttcggaattatgcagcgaactgttaatagtcattctagcaaatccgcttgcatgcatctacattataatttatactaaaattacttgaaaaacaatagatgttcatacatctggaaatgaggaaaaccatgtcacaggaaccatttgattttagcagtacagccgagagcgatttcgcaccgtctcacgcgtatgtatcgaagaaaacaaaaatagaagacgtcacatctaccgcctacacattcacaatcgtaagcgttgccggttttattcttctgatcttgtttggactggatctgcttccttttcacagtgcttcatacacgaaaacactgattcttatcgtcatgggagttatgtttgccatcttctttttcgtcggcataaaatcctttatggaattaaaaacgctttcaaatgcagctgatcgtgaagaaaagcagtttgaagagatctgccactggtttttagatacctacacagcagaaacaatcaatgctgatgccggcatttcagacgattctgacgagcagaattattttctgcgctatgaggtcatgcgcagtctgctccttgaaaaatatccgaagacagatgcctccctcttagatcacattatcgaaacgatttatgataaaatatttttggcttaatacttttttctgtcagatatatgtgatataataggtaaaatatttgaatttatgaggtggctattgtgaaaatacttgaagagaagattctttcggaaggaattgcagtcaatgaagatattttaaaggtagacagttttgtaaaccatcaggttgatcctgttttaatgcatcagatcggtgaagcatttgccgcacactataaagattgtggagtaacgaaggtcgtaacgatcgagagttccggtatcgctcctgctcttatgacagcgttagcgctgaatgttccaatgatcattttaaagaaacagccttcaaaggtgttaaatgataatctgtaccagacagtaatcacttcttttaccaaagggacaagctatgagctgacattatcccagcagtttatcaatgaaaatgaccatgtattgatcgtggatgattttcttgcaaacggcgaagctgcaacaggagcaatccgcttgctgcgcaaagcacatgcaacgatcgccggagtcggtatcctgattgaaaaatcattccagccgggacgcggaaaattaatggaacagggcattgatgtatactctctcgcccgcatcagtaaacttggaaaagatctgatcgaatttattcctgaagaagaataaatatatgcctttggtgtacattaaaagcatgaaaaaagtcagtcacatgtttgtggctgacttttttcatgcaatgttttcttagctgtttccttacggatgatatcccaaatttacacgatagatatcactgactaaacctgtcttgttatttactgccatgacagataatacataatccccttccggaacaacaatcggttctgtataaacagccgattctgttgttggatctgtagaatcccatgtataataaatcgtgcaatctttctgctgtgtgattgttacagtggtctcctcagagaaaactcctccatctggtgagacagatggcagatccggttttttaaactgaatctggtattcttctgttacgatatcactgtagatgcctttttcattacaacatacagcattgatttcaaaatttccagtatgatttaacggaatacctccctgtggatatggaatcccattttctttatccggaacagtgccatccgtcgtataataaatgtcatttccggcaattgagtagatcacgactgtaatataatcatcatattgcccactaagcggagatatgatcggttcaccaacctcataatcatcgaataatgcaagtatattctcatccgtaacatcttcttttaaagaaagaatgctgtcataatcccccatttcatcataaatggagatcagatgctgataagcctctttattcgttttgtcaagttgaaggatttccatatataaaacgagtgctgaatcatattctttctggctggtatagatctctgccattgcctcacgaactttgatatcatccggctgcaatgccagtgccgtcttataatatcgcagtgcattttcataattacgatccaccagctctttttctgccatttcaatctgataatcataggaatttgcattcttattatcgatataaagttttacagcaatgccaacagccgcaccggttatgataagacagcagcagacaataagtgccaaatgactttttttcttcttttttgttttttttggctccggttccttctcctgcggatttttttcaccttctccgtcttttagaagtgaacgcagataatcatcctcaagtacgttgtaatccgaaactatctgtgcttcgtggccacagacagaacagtaaaggcagcctttttttaactctgccccacacttcgcacatttcatgggatatcctcgctttcgacttattagaataatccggtaatcacaccgttatcgtcaacatcaattccatatgcagcagggtttttcggaagtcccggcattgtcatgattgcaccggtaatggcaacaacaaatccggctccggctgaaacataaacttctctcacattaatggtaaatccactcggacggccaagttttgtctggtcgtcagacagggaatactgtgttttcgccatacataccgggaaatctgacattcccatgtctgcgatacgttttaattcctttgctgcggcagatgcatatgtcacaccgtcagccccatagatttcttttgcaatcgtctcgattttttcctccagtgacagatcatctgcatataatggcttaaagtgactctcttttgtttctaaagtctttaatactttttcggcaagttccactccaccttttccaccgttctcccacactttcgcaagtgcaaattcacagtctctctcacggcagaactgttcgatataatcggtttctgccttggtatcggttacaaatgaatttaatgttacaacaaccggaacaccatatttctgcaggttttcaatatgcttttcaaggtttacgatacctttctttaaagcctctaaattttcctctccaagatcggcttttgcaacaccaccattatattttaatgcacggacagttgcaactaaaacaacggcatccgggtgaagtcctgccatacgggatttgatatcgaaaaacttctcagcacctaagtcggcgccaaaaccagcctctgtgatcacataatcagcaagttttaaggctgtctttgtagcacggacactgttgcagccatgtgcaatatttgcaaatggtccgccgtgaacgattgccggtgtatgttctaaagtctgaatgagatttggtttcaaagcatcttttaacaatgcagccatcgcaccggttgctttgatatcatcagcggtaacaggctttccatcataagtatatgcaacaatgatctttccaagtctgcgttttaaatcatgcatatcgtctgcaagacataaaacagccatgatctctgatgcaacagtaattacaaaatgatcttccctgaccattccatccatttttctgccaagtccaaccacaatatttcggaggacacggtcattcatatccagacaacgtttccagacaacctgtcttggatcaatgccaagttcatttccctgctggatgtgattatcaagtaaagcggcaagtaaattgtttgcagaagtaattgcgtggaaatctccggtaaaatgaaggttcaaatcctccatcggaacaacctgtgcataaccgcctcctgcagcgccgcctttaattccaaaacacggtccaagggacggctcacgaagtgcaattactgcttttttcccaagctgtccaaatgcctcaccaagtccgacactgatcgtggtctttccctctcctgccggagtcggattgattgccgttacaaggattaactttccgtccggctcatcttttacacgctcaatcagttcatctgagagttttgccttatatttaccgtaaagctctaattcatcctctgcaatgccaagtttttccgcaacctcacggatgtgcagcatttttgcttcctgtgcgatctcaatgtctgttttcataatgatcctcctcgtgtcttataaatactcttcttcatattgttcaaactgctcctgcgtcattaaaacgcggcgcggttttgtaccttcttccgggccgacaatgccggcctcctcgagctgatccataattcttgctgcccggttaaatccaactttaaaataacgctgcagcattccgatcgagcctttttctttctcgatcaaaagctttgcggcatctgcaaaatatgcatcccttccatctccggttcctgaatttgaatcaatgcttactgtcatattttctgactctgcgttgttcatatgttcttccactgccgcattgtaggaaacctgtccattttcttctttgatgtaattgacaacatccgatacttccttatctgaaacaaacgcaccctgtacacgcaccggttttggaattccctgcggatagaaaagcatatctccctttccaagcagtttttccgcaccgttcatatcaagaatcgttcgcgaatcaataccggatgttaccgcgaatgcaatacggctcggcatatttgccttgatcagtccggtgatgacattgacggaaggacgctgtgttgcaatgatcagatgaatgcctgcagcacgcgcgagctgtgccagccggcatattgcgccttcaacatcattcgacgcaaccatcatcaaatccgctaactcatctacgataatgacgatctgcggcattttttccggttttggttctccttccacatccggaaggctgtcgatcttggcattgtatccctttaagttacggacgtgcgcctccgcaaacttattataacggtcagtcatctctgccacagcccagttcagcgcacctgccgcttttttcggatctgtgacaaccgggatcagaagatgtggaataccattataaacgcttaactccacaactttcgggtcaaccatgagcagtttgacatcctttgggtctgccttatacaaaatactcataataatcgtattgatgcagacggatttaccggaccccgtcgcaccggcaatcagaagatgcggcatcttttcgatatcagccacagatactttaccgccgatatcttttccgacacaaaaagagatctttgaaggatggttctgaaactcctctgattccaccagttcacggaacgataccatgacattttctttgttcggcacttcgatgccgattgctgcttttccaggaatcggagcttcgatacggatatccgctgcagcgaggtttaacttgatatcgtctgccaaattgacgattttacttacctttacacccatttccggctgcagttcatatctggttactgccggtccacagctgatattcgtgattgtgacattgacaccaaaattttttaatgtctgctgcagtttcatggcagtttcctgcaactgttttctggtatctccctgcttgttttctgcctgttttaacagcgtaaccggcgggaagacatattctttctccggcggtacgatttcaacatccatctcttccggaatattatccatatctttcgtctgtactactgtttcatgctgcaccggcagcacatcttcagcagtttcttccggcaacggctcagattctaaatctgccccaaataacgatatagtatccgtttcttcctcatatggaatctcctctgccccctgctccattccaaatgccatcgccggatcagggcgtccaggtataacaaacggtgcttcctctgcaactgtccgtgaagctttcggttcttccatctggattgggaacgatacctgctcctcctctgccgcaaacaactctgtttttgctgtcagcgcctgtcccattgcatctaatgcctcatctgaaaatgcagatggtgttgtatttgatatcgtacttcctgcagtcagtgtgacatgtttttcctctttgatctccggcaaatcgatcatatcttccggcagaatctcactgatatcctgggaacgtttctgcggtgtatccggaatcagctttgtatcaatggcaacgccctcaacctttctgtccattctgcgctgctgttcccgctgctcacgctcttctcttcgcatttcaacacgttctctgtgacgttcattgctgattttggcagactcatacaccctgcgcccacctttttgcatgccacgaaatgcagatcgctccgtgatgagtacaagcgagataatgagtacgatcacatcgatcacatatgccccgatcactccaaatccggagcataacatatgggaaagtccgcctccgatcagcccgcctccacttttcgcatcaaaactgtaccgataagcatccattgcactttttgcatcagttccatcggaaatgagttcaaaaaacatacataaaaatgccacaaacaaaatgaccgccactaattttacggctgccacccggtttccctggttcgaaacggcaaaaaaagtccccaccagtaatacgattggaaatatatatgaaataattccaaataaaccaaaaaagaagcggctgactgtaccgccgatcgtaccgccaaatccaaagttactgataaacagcaaaagtgaaacagcaaccacgatccataaaatcacctcacgcgtaaattcagcttcacgctcctgctgtttttttgtatttctcttatgtccagaatttgttttcctgccggatgatgatttttttccggtagcagaacgcttcctattccctgttgccaaaatattacctccaactcaatttctgtaaatgcacagatatattgcatttatttatgccatatagatatatccgccaatcgagatcacacccacgatcagacagtaaatggcaaaacctgtaaatttttttctgcgtacaacgataagcattgtcttaatgcagacatatcccaccactgcggctacgatcataccaactacataatatgcaatctctgcaccggaaagtgcaactgccgtgcagtcttttaattccagtaccagtgctccaagaattgccggtattgacattaaaaatgagtattttacggcaaaattgcggttaaagccgctgagcagacatgccgtgatcgttgttccggaacgtgacaatcccggaagtgttgcgattccctgtgctattccgactccaaatgcatttgtatatgtaacgctctttggcaatttttctccatctctggtatgatctgcaataaaaagcaggacagcggtaaggatcaggcagatacccggtatcagcaatatctccgatgccatctcgacaacatcttttccaaccacaccgatgattccggttggaatggtagatacaatgatcaaaacgactaatttacggtaactgctgtttacgatccggaggtaaggttcgtctgtcttaccggttttatttccgataaaccggataaggttaataaaacagtctctgatgattccgattccctccacgatcatttttaaaacatctttatagtaaacaatgcagattgctgctaatgttccgatatgtaaaaggacatcaaacagaagtcctgtgtctgtatccacaccaaataatatcttaaaaatcgccagatgtccggaactgctcactggcaaaaattctgttaaaccctgtatgatccccattagtattgcctgtaataatgacatatctgcctcctctttgtatcttcgtaataaatcgttcttttgcggtaactttttacatacatattttatcttaccatatttgaggcagattgtcattaactggttattttttttctatcatctgatgcagtcgggaaaatgcatcggaaataccaccgacttcattgatcagtccttcctccaccgcttctttcccgaccaggattgtaccaagatcttttgtgaggattcctgtattcatcatcagctcctccagacgtttttcacttgctttcgaatgtgtgctgataaagtgaacgatccggtcctgcatctgtttaaaatagtcgtacgtcggttttgcaccaatcacggttccactcatgcgcaccggatggatcaccatggttccggatggcacaataaacgaataatcggtcgataccgctaaaggcacaccgatggaatgactgccgccaaggactaatgaaaccgttggtttgcggatcgatgcgatcatttcggcgattgcaagaccgctttccacatcacctccaaccgtatttaaaagcagcagcagcccttctgtatccgggttatcttccagctctgccagttttggaagaacatgctcatatttcgtcgtttttgtggttgccggaagacagtcatgtccctcaatctccccgatgatcgtcagcaatgaaattttatttttcatctggatctgtccaaactctctgatctcctcatttttcttttcctgattttctgccatgatattctccattcctgcgctgttttttgcgcatctcaagtttgtgcgcaagcacaaatcttgcgtgtgaaaaatcttatttttcacactatactccttttccatgatataaaaaacaggatgtttgaaacatcctgttttttatacgatattctcatttagtatatccgtctgtaaaataatcatacagaaaatcaattttacgcttcttttatatatctttattttaaaaaagcattactaacatccgagcagataattatataatccctcgtattttcctttggaattgttccaggaataatcatttgccatgccgcggtcaatcatctggttccactgtttcttgcggtcgaagaaaatatgtttggaataattgatcacagaaagcatttcatctccattataatttgcaaaagaaaaaccgtctcccgtattttcatattcgttaaatggttttaccgtatctctcagtccacctgtttcacgaacgatcggaactgtaccgtagcggaatgaaataagctgtgtcaggccacacggttcgaagcgggacggcatcaggaatgcatctgctgctgcgtacagtttgtgtgcaagttcatcagaataacagatatttgcagaaacacgatcgccatatttccatgcataatggcggaacatgttttcatactgcggatctccggtaccgataacaaccagctgtgtatagtcgtccacgatccggtcgattgcataatttacaagatctaaacctttctggtcggtcagtcttgagatcagaccgatcatgtactttttcttgtcaacggcaagtcctaattcttcctgcaattttaccttattcatgtattttttcttacggaaatcagacggcttatagttggtataaatctttgtatccgctgccggatcatatacctgataatcaataccgtttacaataccctgcatatcaaaatgccgtgcagacaacagaccatttaaaccttctccataatactcggtctgaatctcctgtgcataggaatcactgactgtagtgatataatcggcatagacaagaccaccctttaacatgttggcatcttttttaaattccagcttatccggtgtaaacagggaagctgaaaatccggtcagtccctgcatggtcttgatatcccatactccctggaactttaagttgtggatcgtcataatactcttcatgccccagtaaaaggaatcagcctgaaattcatttttcagatataccggaatcagacccgtctgccagtcatgacagtgaatgatatccggacagaagtcgatctgttttaacatggacaaaacagccttgtcaaagaaacagaatttttcaatatcataacggacatcaccgtacggtactgcacagttaaaatattcctgattatcaataaaataatatgtaatgccatccatgacatattttaaaataccgacatacttattcgtaatataactgccggcactcatataaaaatgagcaacatattcaaacttgctgcgaaacttgtccggtatgcagctgtaattcggtattacaacccggacatcccactcgtttttgtcaaattccttcggcaatgctccacatacatctgccaaacccccggttttaataaacggaacacactccgatgctgcaaaaagtattttcttcatagcaatctccattcctgtgtttattcttcaaatcttaattactattatcatataacatttccgaaaagaataccatatttttttactgcaaagcagaaaaatttaatacaatgtaaaaaaacttttattttcatataaaaaacgacacagacttttcatccatgccgtttatcttatgtaccttgaatcttatttattcatcccagttgtgatatacttcctgaacatcatcatcatcatccagcagatcaagaatacggttgatatttgttaaatcttcctctgctgtcagctctacataattctgtggaatcattgtaacctctgcttctgccatagggatcttctctgcttcaagtgcagcgtgtactgcctcaaaatcatttggatttgtgatgatctcgtagctgtcatcttcctcagaaaaatcctctgcgcctgcatcaagtgcgatcatcatcagatcatccgcatccatctcacagtcttcttttgcgataatgatctgtcccttttcatcgaacatataggaaacgcatccctgtgtaccgatgcttccgtgtccctttgtaaatgcgttacggacattggcagctgtgcggttcttattgtcggtcagacattttacgatgatagctgttccactcggaccatatccctcataggtacagtactcgtaattgacagagtttccttcaccggatgcctttttgataccacgctcaatcgtatcatttggcatgttacttgcttttgctttggcaatgacctgagccagtttaaagttgtttgcaggatccgggccgccatcttttactgcaacggcaatctcacgtccgataattgtaaaaatctttccttttgctgcatcatttttttcttttttgtgcttaatattcgcaaatttggaatgtcctgacataaatacttcctcttttctcacttgtttattgcttcgaaaatacattttattttatcactatttccgttttctggcaagcctatttatgtatacagctctaagcttacctcaagcgccttatctattttcaccagaatctgggaatctaaatgacataccttgtctttcaaacgttttttatcgattgtgcgaagctgctctaagagcaccacagaatctttgaccagatcatattttctgctgtcaagttctacgtgtgttggaagcttcgctttattcatctgggatgtaattgctgcacagatcacggttggactgtgcctgttgccaacatcattctgtattatgagcaccggtcttacaccgccctgttctgagccgatgaccggtcttaaatctgcataaaaaatatcaccacgtctaattaccatatacttccactccattttcttgctttacggatagtattgccaatttttactggtgtattccattcctttctattattccgaaaaatgatctctcgtaccgatgatccgtccaccatggatataaacacgtggtatacgttttccaagatcacaggcgaattcataattaaaacgtccggataacccgccgacctcttccatggtaatgcactcatcaccatccctgccgatcagtatcacttcatcctcatttttaacatccggaatatctgtgacatctaccataaactgatccatacagacacggccaagaatcggtgcacgccttccgtggatcagaacagctcctttgtttgaaagtcctctcgcgtagccgtctgcataaccgaccgggatcgttgcaatcatacgcggttcttttgtgacataagttccgccataactgattgccctgccagccggaagctcttttacatatgcaacatgtgtcacaagcgataatgcaggttttaagctgattgccgtcttatccacgtcctcagacggccacattccataaagcgtaatccctgcacgcaccatatccatgtttgcctccgggatatcgacaattcctgcactgtttgagcagtggtgaatcgggatacttaccccgcgttcttctaacatgtcgatcattttacggaaaagttttatctgctggtatgtcggctccttatctttttcatctgcttttgcaaaatgggtaaaaataccctccactataatatgcggtagttttgaaagctgtgccatctcatccgctacttcttccgtaacctgataaccgatccggctcattccggtatcgattgcaaaatgaatcttgcagtccctgccgatacttgctgccgcaacggaaagcttttctgccatctctttggtaaatacggtcggacggatgcccgctttgatcatatccacatactgatccgggaacacatatcctaagatcagaatcggtttctgtattccatgatttcgaaggatcagcccctcctccaccgtagcaaccgcatatccataaaggtaatcgagtttttcgattgtctccgcgatctctacggcaccatgaccataaccgtcggccttgatgaccgccataatttttgtatcttttgcaatgttcccacgcattgcatccatgttgtgaagaattgcatccagatcgatctccgcatgcactctgctgtatctgttcatgttgttctccaatctatctttttcattacttttttgttcaacacaaaatctatacgcgcttttactgttgtgtgtaaatatttagtacctttttgatcccggtgatcagatccgaggctgtaaggccctgtaaacctgtcgtctgtaccatgatatcacctgccaaaccgtgaaggtatactccaagaggtgccgcctgatatgatgtcagtttctgtgccataagtgcaccgatcaaaccgcttagtacatccccgcttcctgcagttgccattcccggattaccggaaagattcagataccttttatgatccggcagtgcggtcactgtatgttcatctttcaggacgcaaataacctgattttcatctgcaaaatctgcagctgtctgcaacagattcttctggatttctccaactgtttttctggtaagcctgctcatctctccaagatgcggtgtaatcacggcagtattcttaaaatttttccatctatctgccccctgcactccggtgtttttctgctctgccaccagatttaatgcatcagcatcaaaaagaaatgctttattctcatgtgacgttccatattctaacacaaaatttaatatctgtgcagaagttttttcttttcctagtccgggaccgatcacaatggcatctgcccagtcaaggatctccctcagaaccggttcttccggtactaaagttttatcgtaagtagtaagaaccgcctccggaacactgcactgtaaaatagttctgttttcccccggagtcagcacacgcaccagaccacaccctgtggcataagctgctttcgcagacaaaactgccgcccctgccatattgacacttccggcgatcagcaagagttttccataactgcccttattagaatggctttttctttttggcagtatcgaaaaatctttttcttcaagtgccatcacggccggcggttcacccagccagctttctttcgtgatgccaatatcacatacaatgatcctgccggcatactcatttcccggccagaggatactgcctaatttttcaaatgcaaatgtgatcgtaagatctgcacgaaacgctgtgccaagaatggctcccgtgtccgcagagatcccggatgcaatgtctaccgccgctttttccccggaaagttcattcatccggcacagcatatctgcatattcaccggtcacatctcttgagagtcccacaccaaatattgcgtctattacaagagcaggtctgatcttttccgggatatccatgtatatagaaataccgtatgcatttaaaatatcctgctgtaccctgtttgactccgaacagtgctctttatttccggcataaacgaccgtgacagcatgtccttccaaaaataaaaggcgtgcgatcgcaagaccatctccaccgttatttccactgccacacacaatgagtacttccgtaagatccacattttgtctatgcagctcttccacaaatgctattgcagcgcgctccatcaagagaagtcccggcaccttaaaatgtgaaatggtatttgcatcatatttttgcatttcccggctgtctacaagatatttcatgaaatcctccttgttttgcggagcaaaatgcctgctatgccgcttttgcatagcatgcgcctatgcaggagcaatgcccagcaagctgtgcaggatttttctccttgttttataaggcaaaaaacgccgcacataaatctgtgcggcagctatttgctctctacatttacagcaccttttcagttgccgttttcttctgctttttgtttctgacaatgttgtaagacaactgcatcagactgtcggaaagatgtacattctccacgacaacatttttgtcgatcaattcaagatctacatgggcaaaattccagattgcgcggattccaagtccgaccagcctgtttgcaatcgcatctgccttttccttcggcatggtcagcgctgcgatatctacctgattttcttcacagaaactctctaattcatctaacatacggattttgatcccgcgtacagtcactccgtcaagcgccggatttacatcaaaaagtcctatgataacaaagccaagtttctcaaattttacataattggtaagtgcctgaccaaggttaccggcacccattacaataatattgtgtctctcattcaaacctaagatcttaccgatctcttcatataaatattttacattatagccgtagccctgctgaccgaacccgccaaaattattcagatcctgtctgatctgggatgcggtcacattcatccgtttgctcagatcattggatgatatacgctccacaccggcgtctaatagttctccgaggtaacggtaataacgcggcatccttcggatcactgcctgtgatatctctttttcctgcacaaaaggttccacctttcttacgttctctcgtttattatagtgatttcccctgtgtctgtcaatgtgtgaaatttttaactatctttagctccatccagctgcattgacagatcttcccacgtttcatagcaggtttcaaggcgttccctgcactcctgctgtcgtgcagcaagttcatttaactttgcggaattgactgcattttccggcttcgcacattcttcatcgatcgcgcttatctcttcttctaatgctgcaatctcatcttctatttttttcagactgttttcaatcttacggatccttgcctgttctgccttctgcgcctgccagtcaagtttattgaccgcatcatcctgttttcctgcctgaatatccgatatttcctgtggttttacatacagttgcgtcatgatatcgtgtttttccagataataatcatagtttccaatataatttacaaccgtctcacctgtcagctcaaggatcctcgtcgccgtctgattgataaaatagcggtcatgggaaacgaaaaatacggttccggtatactggtttaacgcagattccaaaatttctttggatgtaatatccaaatggttcgtcggctcatcaagaatcagaaaattcgcatcggaaagcattaattttgctaaggaaacacgtcctctctctccaccgctcaaatctgaaatgcgcttaaacacatcatcatttgtaaacaaaaatgctgctaacacattgcggatcttcgtattattcagccccggataggcatctgagatttcctcaaagatcgtcttttccatatgtaaaagctgatgttcctgatcgtaatatccgatatgcacattcgaaccaagtgtcacggtaccgctatctgccggaatcagattattgatgatctttagtatggtcgttttaccagttccattgttaccgatcagcgccacccgttccccacgtttgatctcaaatgaaatatccgaaaacaatgtgaccggcggataggattttgcaagatttgacacggtaaggacgtcatttccgctgaccatatttggctctaacacgatcttaatatccgtattatcctcaaccggcttttcaatgcgttcaatcttatctaacattttctcacggctttccgcacgcttgatagatttttcgcggttgaatgattttaattttgtaataacttcttcctggtgtctgatctcacgctgctggttgtaatactgttttaacagatcttcacgaacttttgcttttttctttgcaaaatccgaataatttccctgatatacatacgctttatgctggaaaatctctacaacttttgtgacaacacgatccagaaaataacggtcatgtgctacgatcacaacagcccctttgtaagcccgcagaaaattctcaagccagcggatcgactccatatccagatggttcgtcggctcatctaaaagcagtacatccggctttgtgactaaaagtttgccaagggaaactcttgttttctgtcctccggataactcgctcatctgtttgctcaaatcttcatctgaaaaaccaagtccttttaaaataccggtcacttcactgcggtatgcatatccgccctgcagttcaaattcatggctctggcggtgataaatatccatcagcttttctaattcttcaccggtacggctgttcatctcagactccatatcacgaagtttctgttccatttccagaatatcggttcttgcataaagaacctcatcatagatggttctgtgaccggatacatcctgatactgtgctaagtagccgattgtcttatcctttgcaagaatcacttcaccggcatcggacgtttcttcgcccataataattttaagcagcgtagacttgccggcaccattgatgccgacaatcgctgctttttcatttgcttcaatatgaaaacttacatcttttaatatctcatctgttccaaaagactttgagatactctgacatgacaaaatcattttaaactttcctctaacgtcgttctgattgccttgataaaatcttcgctgtttaatacgaccggattcggattcgtagtaatcagcgcaaggtcttttgtcattttaccatcttcaatggtcttaatacaagccttttcgagtttttctgcaaaatcggacaatgcagcattcgaatcaagctctccgcgtttcttaagtgctcccgtccatgcaaaaatggttgcaacagagttcgtggatgtttcctcaccttttaagtgtttgtaataatgacgctgtaccgttccgtgtgcagcctcatactcataatagccatccggagaaaccagcacggaagtcatcatggcaagcgaaccaaatgcactggaaaccatatcactcatgacatctccgtcatagtttttacatgcccagatataaccgccttcagatttcatcacacgggcaaccgcatcatcaattaaagtatagaaataagtaatgcctgctttttcgaatttttctttgtattctgcatcaaagatctcctggaaaatatctttaaatgtgtgatcgtattttttggaaatcgtatcttttgttgcaaaccacagatcctgttttgtatcaagtgcatagttaaaacagctctttgcaaaactctcaatcgaattgcaaaggttgtgctgtccctgaacgacacctgctccggtaaagttatgaatcagttctcttgtttctgtgccgtcctctgcagtataaaccagctcacatttacctgctcccggaatcttcatctcggatgctttgtatacatcaccataggcatgacgtgcaatcgtgatgggctttttccagtttttgacacatggctcaatgccttttacaacgatcggtgcacggaataccgtaccgtctaacatggcacggatcgtaccattcggactcttccacatttcttttaggttgtattcagtcatacgcgctgcatttggtgtaatcgttgcacattttacagcaacaccgtatttttttgtggcattggcagaatcaacggttacctggtcatttgtttcattgcgatgctctaatccaagatcataatactctgtctttaaatcaataaacggaagaagtaactcatctttgatcattttccagaggattcttgtcatctcatctccgtccatctctaccagtggggttgtcattttgattttttccattgtgttctccttttctattgaaataaattgtcccatccgtaattatccatattgtgaatggtgttcatcatgtgctcattcgccagtttctctgccagaccggcatcatgcttctttaatgcctccacgatctgtctgtgttcctgatttgactgtacagaacgcttcggatctgcaagtgtgatttttcgcacgcgttgtacataatgatgaaaatcaagcagcacatgttttaattctttgctgtcggaagcattgtataaaatttcatggaaacggttgtcaagttccacaacctgttccgaatttccttttgcagcatgaaaatccgacagatatatattttcatccagttcatctaactgttctttggtgatcttatccgctgcccactttgcacacagtccctccagacgcgaccgtatctcgtagatatcctgaatatcttttttggaaatacctacgacataagcacctttattcgggataatggtaaccagtccctcaagttcaagctggcggagtgcctcacgcaccggagtacggctgacacctaactcctcaccaatatttttttcctttaactcctcgtctgtcgcatattttccggacaaaatattttcacggatcgtatgaaacacacgggaacttaaggaataattatcctctcccatatatgacacctcatgctcctattgttacatttaattccttgcagcatttttcaatttcttccactaattctttatcggtcaataccgtaacacgtccatcctcgtactgtttatctacccatacttttacttttttcacaagctctgagtttttgtctacgctcttatctttcggaagatggtaataagagttgatccagagagcgattccggcaagaccggatgtgttggaaacagatactaatggtggtctgtttaaaaattttccggtatcaaaaatattgtaaatctcctcatttttgagaagtccgtccgcatggatcccggctcttgtgacattgaagttgctgccgacaaacggggtacggctcggctgtacatagcctaattctttctcaaaatactctgccagttctgtgatcacggtagtgtccatgccatcgagtgttcccttcaactgtgcatattcaaataccattgcctcaagcggtgtgttaccggtacgctctccgattccaaacagggaacagttgactccgcttgcaccgtaaagccatgcggtcgtggagttgttaactgccttgtagaaatcgttgtggccatgccactcgatcagttcagaaggcacacctgcatgtgtggtcagaccgtagatgatacccggcacgcttcgcggaatcacggcacccgggaagttaacgccataacccatagtatcgcaggcacggatcttgatcggaatcttatattcatccatcagtttcataagttctacacagaacgggatgacaaagccgtaaatatcagatcttgtgatatcttccaagtggcaacgtggactgatacctgtctctaagcactcacggatgacacttaagtaaagattcataacctctcttcttgtcattttcatcttatagaaaatatggtagtcagagcagcttaccagaatacctgtttcacgcagaccgatatcttttactaactggaaatcctgtttgcttgcacggatccagctggtaacttccggaaatttataaccacgttccaggcatttgtaaacagcatctctgtcttttttactatataaaaagaattcactctggcggatcagaccttttgggccgcccaggcggtgcagataatcgtagatcgtcacgatctgctctgtggtatacggtgcccttgactgctgaccgtcacgaaatgtcgtatctgtgatccagatattttccggcatattatgcggaacaattcgatcgttgaatgcgatcttcgggatctcatcatacggaaacagattgtggaatacatttggttcctttacatctgccaactgataaaaatgctcttcaagctgcagcagattcgttttcttattcattacaacttctctcataacgtaaatccttctttctgccatggcacttgtgccattgacacctgtgccatgaatgcatatttttacttttagagtgaatattttttcatgcataattgtatacaattatactttttctatattctatacatttcttctcttatttgtcaaggcataaaattttatattttctataacctgaaattataagtatacataatcatatattcaaaaaaatttattcaaatctgtaacacttattctgcgctcacataagatacagtgtaagaaaaaacctggaggttttatatgagtgatttagctgcaacaaactgtggtggtggatgttcctgtaacgagggaggatgcaattccattctctggatcatcatcttattatgctgctgtggcggcaatggtggtttctgcggtggaaacaatggatgtggaggcaacaatgattgtctttggatcatcctgcttctcttctgctgtggcggatgcggcggaaacaatggatgtggtttctgctagtcagatcatctgttctgaaatggcggtcggatattccggccgccctataagatttataaagaaaaacgtctctgcctgttatggaagagacgtttttgtatgtcagccgaatttacggacgctttgtgttctgatcccgtgcagcatactcacggtctttttcccgattctgctgctgcatcatcttctcgtagattccacattcctttggcactttcttttttctgacacattcctcatctatctcataaacactgtttccatcaataatcagcatatttgattcctcctcccgttttattttatgccgactgcctgataccgtcactaaaactgccccctcatccatgtgatatctggcataatctattttccgggttcataaactaaaagaaaaaaggcatctttatggaaccaaattcatttacgccctttgataatatgacacagacccgtgaactgcaaatgttaaaaactgcgattccctatatgaaaggtgaccagaaaaagcaatttgctattctgatcaaatatatggaattacagaatacgatccaggtattcaaccaggaggataaagtcatgtccatgtgctctgtcagtgaggatgaaaattctactcttgccatgttaaatgaccttcggaaattctgtacagacaaagagcttgaaacacttgatatgatcacaaatatggtctctatgatggaaacctatgagactatttttgcataatatattgtaagaaaactgccaaaacaaagcattacatttttgaaaggaataaatagtgatggaaaatgatttctggaataatccggggttaaaaaatatgtccccggaaaaactgcagtttttaatgaattttgcatcaaaagaaaaaccaacaaacattaaagatatgatgccgtttcttcttggcaccatgaatgcagcaaaaacaaataatatccagttcacagaccccgaaacagagctgcttgtcaccctgctaaaacaaaacatgtcaaaagaggaatctgagaaggccgataaaattatccggctcatgaaagaccggaagcaaaattaactaataaaagggatggaacactccaccccttttgtatctgcatatttatttatgatttcttaacattttctcaagtctaccagatggaagctacacttacctctaataatttatcgatcggcgccggactctttcccataccatctgtaccctcaaaatattttgcacttgccgattcaaataaaacaaacaccgtaccatctgcaatagcaacttcttccgaacaaggtggcatctccacttttaccttcggttcatttggttttttgtccaatgaaagaagagaagaataaacttttaaataagaagaattatttcttccataggaagtgcttaaataaattgatccgttatcatcgaatgccactccctgcactttactcggaagattatagttgctgactgccgtcagcttatcttcttttttatcatagctgtatgaatacatctcggaatcaaaaaatctggtatgtgtagcaacccagagtctgccaccgtagcaggtaatgcaggatggtgtatttttcaggcggtattcgtctgacaatgccgatgcatcaatgcaatattccggcgcatcctgtgcgatttttgtaatatattcataggaaatacgctctaaggtattggaatttgaatggcagatccagacattctcgccatcaaaagcaataccgccaagatgactttcttttttcatgccaagtgttaccagatattcgccgctctcacgatcaaacaccatcagtgatccaagatttttgcgatcttccgaatatgcagtaataagaatataatccggtgtgaaacaaagtccctgcatacactggctggaactgctgatcagattatccttatagtctttttccctggtagaaggcattcccggaatagaaagatcatccaaaaaagtataggaacattcctttaactctttctgactgttgtcacgaatcgtgcctgtctgataagaatacatttccacattataatgattgtcaatattttttgtccattttgcaaaaagaaccatattcgccggactgtcttcatctattttcgtaacttttctggaatagctgcagtctgcataccagccagcaaaattgtaacccattttaaccggcacgtccagtgtaaaaggaagttcttctttttggattgttttttgattattgctgctgttaataccgccatttacctcatatacaatgtgatactctgacggatcctgtgtatcaaaaaaatcaaatgtaacattatcactggtaatggtttcctttgaagtatcagggaggatgatcatactgcaggcacgaaccagtttcggatcgcttacaagaaaaataaatacatataaaattacaaatagttctttgcaaatttttctgccataccgcatatccattcctccctgttttctttttaattacacacaccggaaaatgttacatccagtctgtgtttttatcctgctttcgggaagaactgtttctttcagaaactgttttatgaattatccgtattatcaagtttgcctgccctctctgcgatctccttttcctggatatcagaaggtgtctgctcatatcttgcaaactcataggaaaatgttccgcttccaccggtcatggatcgtaaatctgtgttgtatccatataattccatgtaaggaatatcagctacgatctcctgataaccgtgttccgtcggattcattccaagtacacgtccacggcgtttgtttaagtctcccataatgtcacctgtgtatttgtcaggtacaacaacttttaaggatgcgatcggctctaacagaatcggtgatgcttccataatgccttttttgaatgcctgaagagccgcaaccttaaatgccatctcagaagagtctaccggatgataggatccatcatataatactgcctttactcctaccacaggataagctgccatcggtcctttcacaactccttcctggattcctttttccaccgccgggaagaagttttttggaactgctccgccgacaacgcattgttcaaatacatatggtgtttcaagatccccggaaggttcaaaggtcatcttaacgtgaccgtattgtccatgaccgccggactgttttttgtacttgtattccacatccgctttcttacgaatggtctcccggaatgctacttttggttttttcagttcaatctgaactttgtatctctctaacagtttgcttgccacaacatcaaggtgctggtctcccataccgtaaagtaatgtctggccattttcactgtcattgactgtttttaatgtaagatcttcgagcatcagcttttgcaatgcctgcgagatcttatcttcatctcctttgttgactgccttataacgtttataagtatatggtgtggagatctgtgttcttatatacaggatcgggttcgctttggtagagagggaatctgtggtagctgctttagtcagcttcgctaacgctccgatatctcccgcatgcagttcctttacttcctccggcttattgccacagagtacatagatctttccgattttttcctctgtatctttatgctggttgtaaagaagatcatctgttttgataactcccgaattaactttgatcaatgaatatttcccaataaacgggtctgcaatcgttttgaaaatataagctgattttggttttgcaaaatcatagtctgcattgtatacctcgttggactttgcattgattccggtgcaggaacgtttttccggactcggaagatattttacaatgtcgaccatcagtgtatacatgccgcgtgcaagaacattcgaacccatcagcaccggaacgatgcttccatcggatacattgacacggagtgcctggcggatctcatcctcggagaactcttcccctccaaaataacgatccataaattcttcactcgtctccgcaacagcctccatcaatgcttcccggcagataccaagattctctttggaatactccggcacttctaccttttccacttcgccgttatctttccagcgttttgcccgctgctgtaatacattgacataaccgacgaactgtccgttttcacggatcggaagatggaaaggtgcgatccgcttgccgtatagctgctgtaaatcttctacgacctgccggtaacttgcctcatcgatatccatatctgtaacaaataccatacgcggcagtttgtatgtctcacataactcccatgccttctttgtgccgacttcaatgccagccttaccggatactacgataattgctgcatccgcagcactgactgcttcttctacctcccctacaaaatcaaaataaccaggtgtatcaaggatattgatcttggtatcaccccagactatcggtatcacagttgtgttgatggaaaaatgacgtttgatttcttctttgtcataatcgctgatcgtgttaccatcggtaacttttcccatgcgtgttgtcatccccgcaagataagccatcgcctcggcgagacttgttttaccacatccaccatgtccaagcagaaccacattacgaatcttgtcagttgtgtaaacgttcatagtaaatcctccaatacatattttttagtcgatacctctaaacggcactcgttgtatggttacattttactaaatttacacgtttattacaacttatttattcatatttactaactatttttatattacctgaaatttgtttatatattatgtatgcattttaaatattttataaccatttgcatggaatgtttacatagtgttcacatttcatccatactttgattattttttcatgcaatctgcacttttatactttaacgtgttgactttcttgtgatttatgtctatgataggtaaagaattatgagaacagaactttaacatctaacagggggatttccatatatgtcacttcagaaaataggctttatcggactcggactcatcggcggttccattgcaaaaaaactgcatgcacttcatccggaacttacaatgattgcaactgcacaccatgcagaaacagttgccgaagcttataaagaacatttgatcataaacaatacaccatgtgaactgaaggatttcgcagactgcgattacatttttctgtgcacgccgaccaagaaaaatattgaatatctgcagcagttgaaagatgtaatttctccggactgcatcatcacggatgtcggcagtgtcaagacggagatccacagagaagtgataagactcggtcttgaagccaattttatcggcggtcatccgatggcgggttctgagaagaccggtctttctaatgcttcagagacgcttttggaaaatgcttactatattatcacaccgaccacaaagagtccttcccctgctgtggaagaactgaccgggctggtgcgctctctcggcgcaattcctctggttttaggttatgagcagcacgattatgcgaccgcagcgatcagtcatctgccgcatgtgatcgcatacagccttgtcaacctggtgcaggaatcggacgatgaaaatgagatcatgaaaaccatcgcagccggaggttttaaagatatcacgcgtatcgcatcttcttctcctgtcatgtgggaaaatatctgtttatccaatcaggaacagattttaaaattattggacaactatatccatacattagaggtaatgcgcacgaacattgcagatgcagattcccctgcactgttagatgcctttactgcagccaaagattaccgtgattccatcacgatcacggcaaaaggtgctttgaagaatgtttacgaactgtacttagacctgattgatgagaccggtgggatcgccaccgtcgcaacgatccttgcgagcaataatttaagtatcaaaaatatcgggatcattcacaaccgtgagtttgaaggcggtgttttgagacttgaaatgtatgacggggaatcattagcgctggcggttgcactgcttaagaaacatcattatacgatttatgaaagatagaaaaaacgccgtatggtcagattcagaatgaccgtacggcgtttttctgctctttgtaaaacagcaaaagcccatactccagacaatcaaaaagctgtatcccgacgttaatcaggaatacagcctcttgagttgaactgtttacattataaactagttcatggatacaaacatagtttagcacacttttataaaatctacaatagtaaatttcataaaatttaaaatttttttcaaaaaaggattttcacctctattttcattccacacaatcttctctgtaaattcacgcaacttccaacccggcttcatctaaccgtcacattcccccgatagaatacagctatcaacaaaaaaggagtgacaaacattatgaaatatcaaaaagcattattatgtatcgcattggcaggaacactgattttttccggatgcggcagcacaaacaatagtacaggtaataacacaaatacctcttcttctgtagaaagcacagtggaaacatctacggaggacactgatgcaaaatcagatgaaaacacggtaaccggaatgatttccgaaattaccgacagcacgatcacagttgcagccatgccgggcggcgatcagggcgaaacaccgggcaatccaccgagcgataacaaaggtggtgccccagcagacaacgggcactctgacaacagcgattcaacagaggcacctgacaaacctgactctgatggcgcagattccaccgaaacccctggcaatccgcctagtggagacaacaattctgccccttccgacaacggcggtgccccggatatgagtaatatgacaactgagacgatcaatctgaccgactctaccatctattatgacaaaaatggaaaagaaacaacactttccgctttatcagaaggtactatggtaacgatcaccttagatgatgatggtaacgctgcaactgtaacgatctctgacaacgccggcggtcagccgggaggtaacactccaggcggaggcgctccgggaggcagcacttcctcccagccggaatcttacaatgccgtaaccgaatatacggaagataccgaagtttccgatgagactttctcttccaccggatccgatgaaaatgcggttcttgtttcaaatggcgcaaacgttactttaaaagatatcacattagaccgcacttcctccgacagtaccgatggcgattcgtccagtttttacggagatcatctgggacagcatcagccagcttgacgtttcccttgaaaataaaagtacctggaccggaagttttgttcaggatgaaagcaatgccggaaatggcggagacggttatgcaaatctgaccattgacagcagttctacctggatcgttgatggggacagcactctctcctctttaacctgcaaaggaaccattacagatgaggatggctacaccgttaccgtcaaaggctctgatggaaccacttatgtggaaggtacaagcgattatacaattaccgtaagttcttatgaagcataattaattttatgacttacaaataatttattcgtatacctatgctttcataaatgatagcttatggacgaagaatgacagacataaaaagagccagacagatcatctttattttaggatgtgacctatctggctctcttcgattttttgcatttatcctgtcatcaaaagcatacttcatctcttatacttttatgcttcacgaaacacctgataaatatctatttttattgcatctgtatccgacattccaataaaagttgccccatatttgtcggttccatcttccattttctgcttacgcacgatctcgatgactgcatcgatcacctctttcgtccatatctgggttctggtattataatatccccccacttccaaaggttcgtcggactggaagccgattccgccgcgcgaaacatccgtaactacaacctgcgtgtaatcatatgtcgtcgttccatcttctgtcagacgttctaactggatggaaacgtcgagttttaaacgcttatgatgtcttttctcttccattccgtaattctccttctctttcgtgattttttcaagcaatcattttgcccgtaaatcatgctgtctgttgcatcttctcagatcatttaaactgttgtatccgttatcagcattgcatccccaaagctaaagaaacgatatttctcctgcacggcaatttcatatgcgtttaacacatgttcccgtcctgccagtgctgaaactaacattaccagtgtggattccggcaaatggaaattggtaatcagggaatcaatgactttaaacctgtaacccggataaataaagatctctgtccatccgcttgtctcgcgcaggaaaccgttctcgtccgatgccgcctctaaagtacgcgtgctggtcgtccctaccgcaatgacacgatgtccggtctcttttgcatggttgatcttatctgcctcggactgttcgatccggtaaaattccgaatgcatatggtgttttaatacatccgtctccttgaccgggcggaatgtaccaagccctacatgaagtgtcacctctgcgatctccacacccatttcctttactttttttaataattccggtgtaaaatggagtcccgctgtcggtgcagcggcagagccatcatactttgcatataccgtctggtaacggtttttatcctgaagctgatgtgtgatataaggcggcagcggcatctgtccaagctggtctaaaatctcctcaaaaattccatcatagtggaactggatcagacggttcccctcttccacgatatcaatgacctcaccggtcagaagtccatcgccaaaactgatctttgttccgactttacattttttgcccggttttacaagggtttcccagatatcattttccttacgtttcaacagaaggatctcaatctttgcctctgtgccctcttttactccgtacagtcttgcaggaattactttcgtattgttaatgacaaggcagtctcccggtcttaaataatctgtaatatccttaaaaacacgatgtgtcacttcaccggtatttttatccaataccatcagccgcgaactggaacggtcctctaacgggtcctgtgcgatcagctcctgtggcaggtcataataaaaatcttttacgtccatgattctcaatcctattttcttaattccgcaccaacatgctcaagtgctttcacgattcgatccattgcaccagtgatatcggcatcctctaagtttctatcctttgcacggaaagacaaggagtatgcgattgatttatatcccggtttgatctgtgctccctcatagatatcaaacagatcatatttctctaagaactggccgcctttttcatcaaaaatcttctcaatatcaccggcaagcactttcttcggaacaaccatggagatatctctggctgcagccgggaatttagcgattccctcatatttgtggtcgaaagatgcgcgggatacgatctctggcatatcaagtactgcaacataaacgcgctctttgatcgcataatttgctgcaaccgtcggatgaacctcaccgagataaccgatcacagtgccatcataaacaacatttgcctgacgtcccggatgtaagaatggttttccggcttccggatcatattccggtttcagcttcattcctgctttgtaaagaaactcctcgatcacacccttcatggtaaagaagtcaccctctccgtacataccaagtgtaaactgcatgcgctcttccggcagctctgtcaccggtacctgttttggcaggtaaatatttccaagttcatacagacgcacgtttttatttctgcggttaaagtttgtggaaagtgatgtcagcataccatttaaggaaatcgttctcatgatagagaaatcctctccgagcggattgctgatcacaaccgctttgcggagcggtgaatcctgtggcagtaataatttatcgtatactttcgggctctcaaaggaatacgtcatgccctgtgaaaatccgcagaactctgcgatctctcttgctactgcctcgatgcggagtttgaaggtaagttttcctgtggtagcctcaccgcttggcagtgtggtcggaatcttatcataaccgaagaatcttgccacttcctctgcaaggtcggcgtcacactctaagtcctgtctccaggatggaacgatcacttcgttcgaagccggatcatagccgaggtcgatctttgagaaataagccagcattgtctcttttgcaatgtccgttccaagtagtttgttgtatttctccggctcgaatggaatacgtttatcccctttgacattcgggtaaacatccacaacgccgccgacaacttctccggcaccaagttcctctataagctggcatgcacggttcattgcctcgatcgctgtgtttggatctaagcttttttcaaattttgcggaagcatctgtacgcagaccaatctttcttcctgacagacggatatttgttccatcgaagcatgcagcttcaaacagcattgttttaacattgtccgtgatcatggagttttctccacccatgatacctgcaataccgatggcttttcttccatcacagatcattaatacagagtcatctaaggtgcgttcctgaccgtctaaagtcacaaactgctcaccctttgcagcgcgtcttactacgatctctctgtcctcgatcgtgtcaaggtcataggcatgcatcggctgtccatactcttccatcacatagtttgtgatatctacaatgttattgatcgggcggattccctgcgcacgcagtctgcactgcatccattccggcgacggtgcaatcctgatattttttactactcttgcggtgtaacgggaacagagcttatcatcttttacagatactttgatgtaatcgttaacatcttcattattgcctgtttctgtcacaaccggaggaacaaactcttttccaaacgtagctgccgcctctctcgcaatacctaaaatagagaaacagtctacacggtttgaagtgatctcatattccacaaccgtgtcatctaatccaagataactgatagcgctctctccgaccggagcatcttccggcaggatatataaaccgttttccggtgcaagtgggaacatatctctgtttgaaccaagttcctcgatggagcacatcataccgtttgactccacaccgcgcagttttccttttttgatcttaataccgccctcggtcttgctgccgtcatgacctccggcaacttttccaccgtctaatacaaccggtactttgcacccttcagtcacattcggagcacctgtcacaatctgtattgtctccgttccgatatctacctggcagatcacaagtttgtccgcatccggatgtttctcaatgctttttacctgtccgatcacaattttatcaagatcctcatccatgttctcatatccttctaccttagagccggataatgtcatggcatccatatattcctgtggtgtacagtcaagacctggaactaagtctttgatccactttaatgaagtattcataatgctatattctcctatctttttcctagaactgatttaaaaatctctgatcattttcatagagcagacgcatatcatcgatctcatatttgagcagtgcaatacgttctaatccgatgccaaaagcaaagcctgagtattcttccggatcaatgccgctcatgcgcagtacacgcggatgtaccataccacagcctaagatctcgatccaaccctctcccttacagaaacggcatcctttcccgccgcatttaaaacaggtcacgtccatctcggcagatggctctgtaaacgggaaatgatgcggtcggaattttactttggtatcctgtccgaataactgtcttgcgaattctgcaagtgttccctttaaatcagaaaacgtaatgtttttatcaacgacaagtccctcaatctgatggaaagacggagaatgtgtcgcatctacctcatcggcacggaatacacggcccggtgcgatcatacggatcgggagatgtcctttttccatctcacggacctgtaccggagatgtctgtgtacggagcacgatcttgtcattgatatagaacgtatcctgctcgtcctttgccggatggtttgccgggatattaagagcctcaaagttataataatcatactctacttccggtccctctaccacttcgtaacccattccggtaaagatgcgctctacctcttctaaggcaatcgtgttcggatgacggtgtccgacattattcttctttgccggaagtgtcacatcaatgacttctctgcgcagttttgcatctaactccgctgcctctaattttttctttgtctcatctaaaatcttctcgatgctctctctcgtctcattgacaagctgtccgactaacgggcgctcctccgggctgacatccttcatactctttaatactgcggtcagttctcctttttttccaagaaccgcaacacgcacatcattcaatttcgacagatcgccggattcttcgatctgacggatcgcatcttctctgattttctgcaatttttctttcatgataatctccattctgcattatttctttcagatatttgtctcacaaattatttttgtgacacaatttcctgtggtggatttgtttcagcaacaaaaaacgcggagtcattcgtccagggacgaatgattccgcgataccaccctgattctttctgccacgaatattgacaaaaagctcttaacatgcgtaacgtgcatggacgtcatctgctactgtcatttcacaaatgcagctcccgtgcgaacttcgcttcctaccttgtcttaaatgggttttcagccggtgacccactctctctgaaagaattatagtgcactactaatcacgttcaatgccttttcttttattttcactctgtattgcattttagcacaggcaatttattagttcaagagttttttctctttttcttctctttctctttgagcagccacttgcggatactatcattgaaaatgacatttacttccgccgacatcatcataatatacatacagaaataaagccacagcatgatgagggcgatcgtcgtcaggcttccatacatggaaaaaccgttaaaataatccacatagatggaaacaccgatagaaaaaatataccacgccacaccgcagatcgcagcccctggaatctgacttttaaaagtcagctttttatttggcagtgctgtaaatatcacatcaaagaaaacaattaacatggccagcatgataagtccccgaaaatgtgccaaaagatctaccgcatgccgcagtaacgggatatactgcgatgccagtttttggagagaattaccaaaaacaataactaacagtgtaaacacaatagctaccagaaaaatcaccgtatacacaactgcccacatccgcagtacaagccaatttcttgtttcctccagatcattgaccgaattgagtccatccgtcatgtactgcacaccttttgctgctgaccagattgcaacgatcgccgtaatggaaataatgcctgctgatctgttgtatacctcatcaatcagtgaaataagaaatggtgctatgtattccggcataactctctcaatgatttttaaaagcgtcccctctgtcacggaagtatactgtaacagggatgagaaaaccataagaaacgggatcagtgataatataataaaaaacgcagactgcgcagaatatgcattgatcttatcccgtttacattttcccataaacgacatcacatttcctataatcttccagatcataatgtctcttttccttccatctctccgattgtttccacggtaatatcctgataaaaacaatttaagatatcctgatagcccataccggcttttgccattccgtttgccccattctggctcattccgagtccgtgcccataaccaccgccggacagcagatatgtcccgtcttcctgtttctcgacggttgaaaatgcacttggcagcatcgtaatattctctgattccgttgcatctgcgtagacaatttttttcaccatacagcctaaaatcttgcggatgttgtactctgtttttattttcacaatgccgcattcataagtaagatctaatgtaagaatcgaaccggaactgcttcttgcttccactgacattccggtaatggctcccattttctccccggcagcggcgacatccatctccgtcgtaccgtcagattcataatataacacattttttggtgaaatggaatgtcttgccgctaagatctcattcaccgtttctgtcttatccgataaatctgccgttgcaaaccacctgtaataacggatatcgctgtcatatccatccgcactgctcttgatgtacttggaaaatgcagtttcatccgacaaatctatgtctgcatccgcctggtttaagcatgcttttttcagatagccataggacgacggatcatccacattccagatctccgcggtgtctgtgtaacccatggaagtcgaaaaataatatgcctccacaacttttccgttccaggtcagcacctgcccgcatgtcgcatccacagcggcgacagattcctttgtcttttctactttgttataaacctggtaggaggtgctgtcattgatatgtgcaccgtaagccgccagatccgcccgcatcagctgcatatagacataactgcgcgcacacaccgcctgtgtcttaagcgcttccggagaaaagcttgatggcatctcactcggcacaaccgcatacagatattcctctaacggcagttcattgacaaccgtatatccattctctgtgctgcgcacctcaatcgtccccgcataaccatttgatacagccgttccatttccattgcacagatagatcttaccgtcttccgactccggttttacgataaaggtttttcccggtgccatcgtcagtgtatctgccggatgaaggagttcctcagatccggcgcttttcgtttcatcaccacaagttatatcggcatttgtcgaacacttcagataaacatcgctccgggtatttgttccgtcatccgatagcagaagaacacggatatttttgatatcagccggctgtaaaataagaattgcgcagacttcctttcccgcagtcacataagccacattcatattgcccaaaacgacatccgatatggatttttcagacacatctccataggtctggtaaaccggaagcttcccattgtggtggattcttccataatcttcaatctcgatctcagaatcatcataggataacatctgtccctgtatgatatcctgttttgttttgattgcagtaagcgctccatcccgaaataccagatcacatactcccggttcacaggatatccatctctcctgtaactctttttcatagacggcacctgcaaataaaaaactgattttttcatcctgacaggatttcagatatgcattttcaatcgtttgttcctgctctgacacctgtgcaattccaatgcactgatcctcttttatataaacatcataggacatccagtccgtaaaatatgtattctgcagtttcgtataaaaatctccctgattcgtgaccagaaccgtctgatcttccatttccatacggtttagcacaagcagtgtttctttttttacgctttgttccatatcaagaaacgcaaggatctgcgcatatacctggttccattctgtacgcgaaacggcagcattttttcttttttccgaaaaatcaatctgttccgaaactccaagtctttttaacagctcatccagcactgcccctgtcagataatctttttttccgccctcaaaccattcgtcccactcttcctgtgaatatacggtaaaaatcagttcctgctttacttcatcaacgctgatataattttccgaaaaaatttccggatcataattttccttcagttttcctatcagtattccagcaaacacacaaattaaaaccgccaatattactgccgaaatttttggcatatttctttttttcacgctaatctccgtttctgtatcaaatacctttgatttccgtcattttattacataaaagaagctgcttatatttcaaagcagcttctcttcgtatttttaaatattcctttgtatatcaatgatttttcatctgtataccgaatattcttctgtacagtaaactttcttttgtactctttacttcttctgtactttaaaaatcttctgtaccatatgatcttttgtataaacccaaaatgccgtttcctacgtttttgactcctagcgaccgctaggtgggtaaccgcacgttggtttctgtcttccactgctcacgtaccgaagtactgatggcttgacatctgccttcgaatataagaatcccataaaagtaaatgtaggttcaaaaatgtagggtgtcgcacatcccaggccgtttttgatagtcttattatactttaatatgccctatttcgcaactataaattagtgccaaattttgttttactttctatctattttctctattgacaaaagctgctttacctgttcaacagcttcctccatatcatctgtccgtatggaaaagtcacagagttcctcattgtcaatttcattttccaacgataataagcggtacatcttctcctgattactgatatctttttctaaaatacttgaaatcatcttttcgcggctgcttctgcaaaataagatcgaggtcgtaaacagccgtttcatggatatcgcgcctccaatatcaagcggtacaatcggacttaccccatcctttatcattctggcaatatctgatgctgatattccatatttattgccagcatacacagttactgtcacaaaatcattttttttatttttaaattcttctgcggaaagtctctgatggattccatctgctgttcccgtcgtataagaatgaacaatcctgcctgttcctgccctctcaagtctttttgcaagttcattttttccagaaccggatggaccgactaaagctatcacagacggtaaagaaaccggctttttatctaacagcatcgattctttgatctgatcgatcagctgtaaaaactctccataatggtttacggaaagaatcccactgagtgattcattccatgggcgccgcattaaaaccggatattttgcacaactctttaaaatattatgcgggccgtcatccagggtaacatcaaaatgaaccagtgacttctgaaaacccataataatattctgttccgggaaatccggaaatgccgtcaatatctgttttgcccgcagactcataaactgtggagcgattgctgtgataatatatactttcccctttttctgcaattcatgtatgaaatttctggcttcatcggtcacagtctgcattcgataaatgcgttcgtcctgataatactgcttgataaccgatgccttgccaacattttcccatgaattgatatcttccagtttcagatctaaaccatgttccccattggcaagctgtatcgcatgggtgttcagatccgagatcacgtcatcccagtcaattccatatgtcagcataacaatcattcccccttttccataaaattcctgtcatttattttaacacttaccccatcattaaaacaaaaagcaaaaaaatcgggtgtgaaccagtcacacccgatcaaaatccacatcaatatgatttatttctgaggacctgcagaaactaatgctttaccagcgtcgtttccttcatatttagcaaagttcttgatgaatctgtcagcaagatcttttgcttttgtctcccactcagatgcatctgcatatgtgtcacgtgggtcaagaatacctgaatctacacctggaagctctgtaggaacctcgaagttgaacattgggattttctttgttggagctttaagaatatcaccagaaaggatagcgtcgatgattcctcttgtatccttgattgtgattctctttcctgttccattccatcctgtatttacaaggtatgctttagcgccgctcttctccatcttcttaacaagctcttctgcatattttgtaggatgcagctctaagaatgcctgtccgaagcaagctgagaatgtaggtgtcggctctgtgattccacgctctgtaccagcaagttttgctgtgaatccagacaggaagtagtactgtgtctgctctggtgtcaggatagatactggaggaagtactccaaatgcatctgctgataagaagattacgttctttgcagccggtgcagaagatacaggttttacaatatttgtaatgtggttgattgggtaagatacacgagtgttctctgtaacgctcttgtcatcaaaatcaatctttccgtttgcatcaacagtaacgttctctaacagtgcgttacgtttgattgcattgtagatatccggctcagactctttgtcaagaccgataacctttgcatagcatccaccctcgaagttgaatacaccgttgtcatcccagccgtgctcatcatcaccgattaagagacgtttcggatctgtagaaagtgttgtctttcctgttccggaaagtccgaagaagattgctgtattctcgccgttcatatcagcgtttgctgaacaatgcatggaagcgatgcctttaagtgggagatagtagttcatcatagagaacatacctttcttcatctctccaccgtaccatgtattgacgataacctgctctttggatgtaatgttgaatgcaacacatgtctctgagttaagacctaactctttgtagttctcaacttttgcttttgaagcattgtatacgataaagtccggctcaaagttctcaaattcttctgctgttggcttgatgaacatgtttgttacgaaatgagcctgccatgcaacctcaacgatgaaacgaactgccatacgtgtatctttatttgctccacagaaagcatctactacgaacagtctcttgtttgaaagttctttctttgcaagatctttcactgctgcccatgtttcctctgacataggatggttatcgtttggatattcctgtgaattccaccatacagtgtcttttgaattctcgtccataacgatatatttatctttcggggaacgtcctgtatagataccagtcataacgttaactgtaccaagttctgtttcctgaccaacctcataaccctcaagacctgctttggtctcttcctcgaataacatctcgtaagaaggattgtgaacgatctctgttactccggtaatgccatacttgcttaaatcaatatttgccattgctctttaacctctttcctttaaaataatcagggtatttttttaaaaattccgctaatataaatatacacaatgttatttttttgtcaatcagtttttgtaaaataatgtcatcaattcttctgttccaactcttttgcaatcggagcaatctgcaccagtaaattctccatattttcaaacatggtactcttttgggttccaagatcatttgcacgttctatgtgtaggcacaccgtatcatactctgctttttcacgctcaagtgaaccgtttacatcggctaatttttctcttgaatcatcaagcacctttgcgatttcctgctgcacctgatctgctccgccggctgctgttgtgatgcggtcaaacacttcataggtttcatctgcactctctaaactcttcccgagcgattctttcgatgttgtgatactgtgattcaaattttccgtatcctgttccacttcgacaatacttccatctacggaactgacaagacttttgatctcacttgccagattttttacttcctctgcgacaacagcaaaaccttttccctgctctcctgcacgcgccgcctcaattgacgcattcagtgcgagcatattggtctgattggcaattgaaatgatctgtcccatacattgcttgattttctgtacagaagcctgaaaatcttcaaatgtgcgctggatctcgtcaaaatgttcctgcacttccccggaactctcctttaagctgccaactttctgttgtgcctcttccaccgcttttgtgatatcttcccttacaccggcaaactgtccggatgtctcaccaactgtctcaaacgtcttatgaaaagaaccaagcttctctttcagctgtttgttttcctctaaaacggtctgaaatgtattctgaatctcctgtaattcgtccagcgaatttacttccgtcaatgataactttttatggtagtcaagcaggctgtccgatacatgtatcaacggatgcagatttaatttttcttccgtctgcagcacctgttctttggtctcttttacctgttttttgaattgaaacatctgcacttccccccctactcaaataccacacaggacatggtctggtttacaaactggctgttgtagtgttctccaaagccaaccagacctgcatgcatgccaagtgttcccattgtttttaaatactgatccatataacgttcctgggagaagaacagatagcggaaaatacagtttatggaaaaaataccggaaattcttccgaaatctcctttgatctgtcgcactgtttcttcgacaatagaaggataatcatttgtctcaagcagataaagtacatcggaatcattgacctggcgataacagcacagaccatttcctgctacttccttgatagagataatacagatatcctttccgttctttttgcccagcggatttttaaatgtctggttgacaatatcctgttctctgattcccagcgtatcctgatacgcctgtcttgccggctttccgttcaattcgccgactgtgtatttgctgcggtctgtctttgatgcaataaaacggtactgtgggttcggataataaatattttccttgtaaaccctgactttgccgccattattttttacaaatgcaaacacatccgcatctgtatatactgtgccatttacggaaacctttccaccatccccggttccgccggtcagtgatattttctttttttcaaggatactgtacatagtcgtaagaactgctgcatcgtttcctgtacaaaaatcgatacatacagtattctcagatgatgcatttatcttctgcagcgccttttccaccctgcttatatatttcaccggcataatggatgcctgctctagtacatccgtcacagcctctacaccctcaaatgctgtcacactgacacctttttccgtcacactggtctggtaactcattccaatgcatccgatgcttggtacgcccggatataattcttcaagttcagctacatgtgtttcaaactgttctgcgttcgacatcagaatcaaaaatgccggattactgatgccccgtacagcttcttttaaatttccactgggacttgttccataactctcctgcatccgtctgtttctcctttatctcttttgtttcagatttcaaacatatccgcaaaaattatcctattttccgtagcatctgtcaagttttcctggtatattttacaattctttcccggtggcttttgtaatatcctgctttgtgaatgcccccggcaataattcttctaatgtaaatattttaaaatcatccggcgtatttaccaggattacctgaaatgtttccggatcacagaattctgccataacctggcggcacactccacacggataaagatagtcattggcatccccattgatcgcaatcgcagtaaattctttttttccttccgatacagccttaaacaaagcggtcctctccgcacagtttgtcggtgtatatgcggcattttcgatattgcatccccggtatatcccgccatcctttgtaagaagtgcagcacctaccctgaaatgtgaatacggcgtataggcaaattcttttgcagcaatcgattcctgtgccagtttctttatatccatctgtttttttcctcctgatttatgtataacattcaatgatttgttctcattttacccgaaaacggctttcatgaaaagtttttttagaaaactcttgtgccataagaaatacttatgatatgatgattaaaaatgctttatcgctataaagtaatgaattaaaaaacatggagggttatttatgactaccaatcgtttctgcgaaatcacccctgaattacagcatctctcaaagctcagtgagcagtgtgccagaattgatcctgctctctatgcaaaatatgatgtcaaacgcggtctccgcgatattaacggtaaaggtgttttagtcggtcttacagaaatttctgatgtatgctccacaaagatgattgacggcaagctgcgtccggcagacggtgagctttattaccgcggttataatgtcaaagatattatcgacggcacatcggaaaacagtcactttggctttgaggaatgcacttatctgcttcttttcgggaaacttcctgcccggacggaattaacggaatttacgaaaatgctcagtgaatatcgtacccttcctaccagttttgtccgtgatattattatgaaagccccaagcaaagatatgatgaacacactcgcaaggagtgttctcacactttattcctatgatgaccttgcggatgacatttcgcttccgaatgtactcagacagtgtttacagcttataagtctgttcccgcttctttcggtatacggttatcaggcttacaaacattaccatgacggtgcaagcctttttatccatccgccaaaagctgagtattccaccgcagaaaacattctgcatattctgcgcccggacagccagtttacacctttagaagcaaagcttttagataccgcactgatccttcacatggaacatggtggtggaaataactccacatttaccacgcatctggtatcttcatccggaacggacacctattctgtgatcgctgcttccttaggttccctaaaaggtccgaaacacggcggtgccaacatcaaggttgtccgtatgtttgaggatatgaaagagaatctctccgactggagcgatgaggaagaaatcagccgttatttaagagcattattacataaagaagcctttgatcatgccggtctgatctatggtatggggcatgctgtatattccctttcagatccccgtgcccgcattttccgttcttttgtagaaaaattgtctgccgaaaaaggctatgaaaaagagtttgctctgtatgatgccgtatcacgcttagcaccaaaaatcatcgcagatgagcgtcagatttataaaggtgtcagcccaaacgtcgatttttacagcggctttgcttacagcatgttaggacttccggtggaactttacacaccgatctttgcaatcgccagaatcgccggatggagtgcccaccgtcttgaagaggttgccatcaacggcaagattatgcggcctgcttacaaaaacatcggagaacacaaagaatatattccaatggaaaaacgctgacccgccggtcagcgttttttatccgctatcgttctatcttaagttcaaaccagaacgtcgaaccgcatcccggttcgcttaccacaccgtatccggcatgatgaagttccagtatattttttacaatggaaagtcccagaccggttcccatcacagcacgtttatgtgtcttgtccaccttataatagcggtcccacacataaggaagtgcctcttttgcaataccatccccactgtctgtcacttcgatccgcaccttatcccctgaaattttctgacgtacccacaccgttttatctttcccggtataattgatcgcattgttgatcaggttgtagattacctgataaatcttgtattcatctgcttttacctgtacttttccgtcatattcgaaatgaatacagtagccatcctgctcttttaatttattgtagcgctctaaaacagattcgatgctctctgtcagattgtatactgtgtcatttttttccataacaccagcctgaagttttgacatatcaagcatatcattcacgagatttgtcaggcgcccggcctcatcgatcactacctggacattttccggtgtattttctcccggaagatcacgcatgacctctgcataggcaatgatcatcgtaagcggtgtccgcagatcgtgcgatacatttgcgatcagttcccgccgcagggactcatttttgccaagttctttcgccgttgcattgagcgtgtcggacagttccgccacctcacggtaatctttcccctcaaaacgcacatcaaaatctcccttggcaagtgctttcgccgactcattgatccggatcagtgacttggaaatctgtctggatattaaaagagcgatccccagtgaaagcaggatcatgatcacagtgatccatatcagttcgatccgcagtgtattaacagttgcatccaccggagtaagctgcgtattgaccagcagaatctcttcctgaccgtcacactctacaatttttacatagatcacacttttgatgtgttcctgtccgcgtttctgcaaaaaaccgtggaatccggggccatatgccacatcttctggttccggcatatcttcactccagaattccggattgatcccgccctcatattcgattttaaaaatcccgccatgttcttttgcctgttcataataatactgtacctgttccgacggcatatccgcaagtctggaatttacaatatactctgcgctgcaaatctcatttccatccgtatttgtcacatagactgccatattatttttcgctgcaatgtcatggatcagagtgtctttatcatcctcatccgaggtcagtatatttgcaaccgccgacgtgacctgctctgcttccctgcttttgatcatggtgtagaacgaatccagataacagatctggatcagccataacacgacaagaagtattccggtaaagacaagcagataggtaaatactctccatttaatactgattttttcatgcttcaaaccggtatcccacccctcttaatgtcactaaaaatttgcggtattcacccagactgctccgtaaaagtttgatatgggtatctaaggtcctgtcatcaccataataatcatacccccatacctctgtgatcagtttttcacggtcaagtgcaatattgcggtttcttactaaataaaacaaaagttcgtattcttttggcgacatttccacacgcttgccatccacagtcacagttcgtccggtaaaatcaacaaccagaccttctgcctgaaagatctcatgtccgtcccgtacgtcttttttattgtttctgctgattacaacttttacgcgcatcataagctcacgtggcgaaaacggttttaccacataatcgtcgattccgagttcaaatccatggatcttgtcatactcctcgccgcgtgccgagagcataatgacagggatctctttgaacttgcggatttccaggcaggtggaaaagccatccagttccggcatcatcacatccagtatgatcagatcaaaatcttctttccggcagatttcaactgcttccattccgtcatgtgcctccgcgatctcatatccttcaaattccccatattttcgaatgatcgcacggatcttgtcctcatcgtctacaactaaaatacgttccataacgtcccattttctcccacaaattgacattttttctattcattactataaccggcttatgtgatggctgtgtgactgccatctgatcaacatcttaaatatgcaggaatttttccctggcagtctttaaactgttctgaaaccacaaaaaagatccaaggaaaatcacaagttccagcagcgtcagttttcctaagaaatttgtgagttcgttgatgataccaatcagtcccaccagtgccacgattcctccaaacaccgcctctctccagtaaataaatgcaataaatcccgccgtatccttacattttttcatctcttcctcagcgatcaccatagcattgatcctgccgctttttttcatctgaagtgacgatatcaccatataaatcccaaaaagcagaatcactgcgtcaaatacaagcattactttcattttaaacctccagcataaaaattcttattttgacattctttttgtcccatatttttattataaacacaatataaaattggtgcaactgaacattttgttttgtttttttgttactgttcagaccattgtaaaaactgacgaaatttaaaaaaatatatttgtggataaactcaagcaggatgggaagtctcgttaacgacttccgaatcctgctttttcttttgaaattataaacagtacctgcatgttttcctgcttttacatggctggaatacggatttccactcctgcttctttcatttttctgccggttatccaccgtcattctgccagtcccgtaattcgtccgatttcccattcgtccctgtttctgctatacttatcctatacttaaggaggcacaaatgaacgcagatgataaaagcaaactcaaagcatatgaagaacttataggcagtcttgagcatacaaacggactacagcacagggtcatcgaaacccagtcctcattgatcaaatcccttgaggaacataatgcagaattagaaaaaatcattgatgatctgacaaacatttaaggaaaggacgcggcatggggatggggaattcttttgaaaccattacagtacttcaatacaggctgaaagcagcacaggaagaacttgcagcctttcaatcgggagaaaaatatatccgaatggaaaaacagcaccttacacaggtgcgtgccctggaacgcagaattgcaaaactggaagcagctgtagcaaaagaacacagccatgccattacgattcggaatcaatggtttgagatttttgaacagctgcaaaaagaatgcgaccgtatggtcgccgaagcagtaaaaaaggcggatatgatggaaaaaagggccatccgtgcagaaaaacagcgcgacatcgcccttgaaaaagtaacttcccagagacgggaactttacaaagtaaagacagagcttgatgatgaaaaacaaaaagtacagaaactgacggcacagattaaccggaactatgaaaactcatccatcccgtcttcaaaatctatcgcccgcaaaaaaatatccaacagccgcgaaaaaacaggaaggaaacccggtggacagccaggacacagggggcactgcagaaagaaactcaccccgacaagggaaatctatcttccggcacccgaagaagtactccatgaccctgactttaagaaaacatcgaaaaccattacaaagcagaaaatcgacatcagcgtagaagtgcatgtgaccgagtatcatgccgatgtgtactataattccaaaacaggtgaacggatccatgcaccatttccacagggagtcattgatgacgttaactatggaggaaatttacgtgctttcctgtttctgctgaataatgactgctgtacatcaattgataaaagccgcaggtttttgtctgatctgacagatggaaaaataaacatatcaaaaggcatgatcaataatctctgccggtcatttgcccaaaaaacagaatcccagcgtaaagagattttctgcgacatgctgctttcccctgtcatgcatacagactgtaccaatgcccgtgtaaatggggaaagttcgtatgtatttgtatgtgcggttccggatggcggtgtgctctattttgccaggggcaaaaagggacacgatggaataaagggcacggtcgttgaagactatcaggggacactggtccacgatcatgatgtaaccttttataagtatggaaccggccaccaggaatgccttgcacatgtactgcgttatctgaaagacagcatggacaacgaaaaggaccgtacctggaacaggcagatgcattccctgatacaggaaatgatccattaccggaatggtttatctgaatcagaagagccagatccgcagaccgtctccgaatttgaagaacgttataaaacaatcctgtccatagctggggatgaatacgactatgagccgcctgggaaatactaccgtgatggatacaacctgtacaaaaggatgaaaaagtataagaaagatcatcttcttttcctccataataagaatgtacctgccacgaataacgaagccgaacggctgctgagaaaatataaaagaaaacaggcgcaggctgtgtcattccggagtccgtcaagcatcgaccatctctgtaaatgcatgagcatgctggttttgatgcgcagaaaagagcagaccaatctgttccgcgagattgcagaaatatttgcataagaaaaccgatggttttgactacgattagtctataccatcggttcttttgttacaagtttacctctgaacagtaacgtttttttacataaaatcccatattttcggtcaagaaacattgaactcttgcgccgattagtgtaaaataaaaataacatacttatagatgggggcaaaaaaccatgaaatttgatgacacaaaaattctcatcagtgacgattctattttagcaagaaaacagttaaaggatatcctctcccagtttggcacaccaacatttttagaggctgcaaacggacaggatgctattgatatttacaaaaaggaatccccttcgcttgtatttcttgacatcgttatgccgatcaaagatggcaatgctgtcatacatgagattactgattttgatccagatgctactatcattattgtctcttctgttggtacgcagtcccagctccgcgaagccattgaggcaggtgccagtgattttatccagaaaccgatcaatgcggatcagatcgaacatattattacttcaagatttgaagggagatagacatgtacgctcaatttttcggaaactatttattatcacacgggatcacaaaagaacagctgatgcatgccatgcaggaagcaaataacgaacatccaaaattaggaacccttgccatgcatgcaggctatatgtcagccagtgaagtggaccgcgtaattatcatgcagacacatgaagacaaacgtttcggtgaacttgccatccgggaaggttatctgacagaagctcaggttacggagctgctgcagacacagaatcctaatttcttacttcttggtcaggcattattaaatgatggtgttattaataatgagcagctccagtctctcatcatcggttatcagtctgagaatgaactttacgatgcagatatgtccgctgaaacgaaggatattgtagatcaccttgtagaaaatttctttgttattgctgagcgtccgctttcacctggagagctttctttcctgcatctcttatttaacgatctcgttcgttttatcggggatgatttttcaccggttcgccctgaactttgtaaagaatatccgacaaactattgtatcaggcagcagatcaatggtaaattttccattcgtacttatatcgatatgccggaaagcacctgcattgcatttgcatcccgttatgtcaatgaagattttcacagttttgacgaatatgtacagtcttctctcgaagatttcttaaatctccataatggtctgttcaacgttaatatgtcaaacgaacaggggcttgaactgcagcttgatgttccaaatgttgtcacagatgaactggtcacatttgaacacgaggcatatatgttaccgattgtttattcattcggaacaatacattttatatttgagttgattcataatgaactgtaaacaggtacatcataaacaatagagtgactgttattatgaacagtaaaaacggctgtgcccaaaggcacagccgttttctattctttttacattccgaggaactgttttacaacctttggcatctcttctacttcgcataccgtcttatgacgtacctcagcactacggatctcctcaattgcctgcgggatttttatgttaccgatcttgcttaattcatccactaattcaaactctgataaagaatcatattttggatcaatggcatccataacacttctgctgaatttaaatgggctggctgtggaagcgatcacagtctttgtttccgcatcatttgtgtcttttttgtacttgtgatatacggatgcagcaactgctgtgtgtgtatcaatcacataaccggttttctcatacagatcgcggatggtatccgcagtttctttctcactcgcataattgccgtaaaagtcagcaagtttctctttcatctctgatgtaatctcgtatttaccagttgtattaagctctttcatcaatgccgcattcttagctgcatcctctccggcaatacggtagatcagacgctctaaattactggagatcagaatatccatagaaggagaacttgtcagcataaattcacggttcttatcatatgtgcctgtggagaagaaatcataaaggactttgttctcatttgaagcacagatcagttttgcaaccgggattcccatattttttgcataaaatgcagccaggatatttccaaagttaccggtagggaccacaatattgatcttctcatcttttgcgatcacaccgtttgcatataattttgcatatgcatagacataatatgcgatctgcggaaccagacgtccaatattgatcgagtttgcagaagaaaactgatatcctgcagcatccatctcctttgcaagctctgtatctgaaaacattttcttaacgccggtctgtgcctgatcaaagttaccgtggataccgacaacaaaggtattatcacctttctgtgttaccatctgtttttcctgtaccgggctgacaccattctttggataaaatacaatgatcttcgttccctttacatctgcaaatcctgccagtgctgcttttccggtatcgccggaagtagcagtcaggatcacaatatcatttttgacattgttctttcttgcagcagtgatcagaagatgtggcagaatggataatgccatatctttaaaagctatcgtcggaccatggaacaattcaagataatacgcaccatccgcatccaccaacggtgcaatctcttctgtatcaaacttactatcataggcagcattaatacagtttttcagttcctcctctgtataatctgtcagaaacagtttgagcacttcataggcagtctcctgataagtcatcttagaaagttcttccatgcttacatccaaagacggaatctcagtcggtacatataaaccgccatcatttgccagtccttttaaaattgcctgtgatgctgtcactttttcatttgcgtctcttgtgcttgcatacattaattccattttcttcgtcctcttatctttttattcatcgtaatcaaatttcggggttctaatactgttcggtattatatcaatacgttttcgtatgattcccaatactttctaaacattatataggaaacgattgcttcatgtcaatgctttaacgtatgaaaatattattttaccaaaattgcagccggttgcatcctgcttcgaaacgtgatatgctgaatacaactcactaatgcaccataacattttttgaaatggagaattcttatgttaaaaggcgtttttcctgccacaaaaaaagatggaaccatctactatcgtacaagcatcaattattccggcaaacacatcagccttggaagttttgcttcagaagaaatggcgcatctggcttataaggaagcatcccagactctttctgacgccgtcataaccattgacaatgtctattcacacaaaaatattctccctcatgaaaaaatcatcattctgcttaatttccgggacaatggactttattttaaaaatccgatctatctgcgcaaaggatatttcagctattttctttccgaacatgaggaattaaaatttgatattgatgatcttttttattattccagccataagatccagaagcggcagggacatctttttgtcagtgattacggaatgcagtattccattctttcacgttatgggatccgtccatacgcggttgccggaagagattatcagtttgtaaatggagattcttacgactatcgctatgccaatattcttgtgatcaatcgttttcacggtgtcttgcgtcatatcgtgaaagggatcacaaaatatcgcacaatgatccacatcaatggcaattatcttgtcggcacttattccagtgaggaaaaggctgccgtggcatataacaaagccgtagatctcgcaaaggctgccggaattaaaaaggattttcccgaaaattatgttgatacactcccgccaaaggaatatgcagaagtttatacgaaaataaagctgtctgaacgttatctttcctatttagaagaattttcaaatagcccagcgtaagtttcttgtatcttccacttaaaagtagtacaatagaaccaaagttttttcactattcctactgaataactatatataagaggagactttatttatgaagcaaaccactttcagcgatcttgaacgaaataataaaacctgtatgtatgcacatctgattgattcaagtatcatgacacttttctgtatcctgcaggcgctttccggacttcaaacctggggatatatcattatcttcgcagttttgggttttggaccggttattgcagagtttttcttttggaataagtcacatgaaacaccagcgatccagcatcttgttgccatcggtttcgctgttttttacagttttgcaatcttcactgcaaccaacggtctcgtatttttatttgttatcccgatgatcttaatcatctcagtttataatgatgccaaatactctctcataatcaataccggaacagtcatcgaaagtctcatcattacaattatgggggctcagaccggaaagtttggctactccggacaggacaatgccgtgatccaggttgtcatcatgatcatggtcggtatttattcttattttacatcacagacattaaatatcaatatggcacagaaaatacagcatgcagaggaatcacagtcacagtccgaaaaactgctggcaaacctctctgaattatcagaccacgtcaatcagaagatcaacagcatccatcaggagcttgataaattgagcactgcagctcagaccacacagcatgcaatgcaggaagtatcaagcggtgctgccgaagcaacgaatgccgtaatggaacagggttcccagacacaggaaattcaggataagattgtgatcgtcaatgatgtaacacagcagatcgatgcaaacatgaaacacactttagatatcgtgacagaaggcagtagttccatgcagcttctcgccagccaggtagatacctctgtccaaaacagcgtggatgccgcatcaaagttagaaactctgaaccattacatggaagaaatgcattctatcgtggaactgatcggcggtatcacttcccagaccagtctgcttgcattaaacgcaagtattgaagctgcaagagccggagatgccgggaagggatttgcagtggttgcatcagagattaccggaatggcttcccagacaaaagaagcaactgtaaagatcacggaactgatccagaatgttacttcagctatcaacgaagttgtcacagtcatccagcaaatgatcgatggaatcaatcaggaaaaagaaagtgctaaaaacacggcaaacagtttctcctcgattcaggaaaacacgctctccattcagagtggtatccagaacctgaccgtaagtacctcagagttaaaagatgcaaaccaggtcatttctgattccgtccagacactctctgccatctcagaagagcttactgctcatgcacacgaaacattagaagccgaaaataaaaatacagatatccttgatactattgcctcaaagatgcaggagcttgtaatatttacacaaaatcagttttaaatctatttgatcaaaaaacatccggcagaccttttttagttgccggatgttttttatgtcatataatattggcaggaaacgtaatgtcacctttttactgatttttatgcaaaccaattctatttgcttaaatattttctaccgcatcacgcagttcatctgccatactctgtacacaggatgtctgtgacgaaatttcctccgatgttgctgcaatcgttgccaccttctcattcatttcattgatattttcaatcagatctttgatagaatcaatgcttgcattaatcttaggaatgatttcttctgcttttgcattgttctctacaatcagttttttcgtcgaatcggacaattcacgtatctcacttgcaactactgcaaatccacgtccagcctctccagcccttgccgcctctatggaagcattcagggaaagaagatttgtctgccctgctatggaagaaatatcctcattgcttgctttataaatattgataaaatcagacatcgttgccaatgaactgtttaactcctgacagaaattggagatctcctgaatatgctgtgcaagcgtggtcgcctcatttgccgaagtttcattcgcgtcacccagctgatcaatattttcactcaaagatacaaactgttctgtaatatcggcaagtttctgattatgaatttcttgtttctgctgttcctcttccatcagattctggatcttttctttttcattctccgcaacactcttgacataatgtacacagttttccttgacatttacaccattataaattgcccttgccatattgcgacaggaagaataaccacaggactcacaattcattttctggctggcagcatccgtcttattcatggaagcaaaaatctcctgcatttcatgctccgcaggctctttaatctcaacacttttgtttgtatatttgcgtacaaaatcattgatatctaaatcttcaaatgctttcatcagatttaccaaacgatccttctccggtacggattcgtcccatggtgaaccattctttgtcttcttgccaaacaatcctcttttcgcgtctgctcctgcatttgccgttttgtttctcatatcactgagtgtgagcataacatcatccgtattgcgctctaactcagtagctgttccatagatgcatcccttagagcagtttaaaatatcgaccataaacggctgtctcttattctttttgatacgttctaaatactcatgcagatagcgataggcttccttttcgccttctacctgtcttaccacctgttcttttccaaggaaatgttctacgttttctcttaaaccacccggcatcggataaagagcacccatgccatattccagttcgtcctcatattccttacagccctgatatttatttccaatcgtttcaaaaagctttttaaatgtcacattatattttacatagccatagcaatttggatctgtaatctctgtcttctttgcgatacaaggactgataaatgcaagttcatcatcacattttaaatatttttttatgtaaattgccatacacatcatcggactatgaatcggcatcattttcggcagtaattccggaatatatttttccacataattgacaactgccggacatggctgggaaatgccacccagaaactgatgttctgtaatatattttaaatatccccatgtcgtgatatctgcaccgaaagaaacactgtaaatatgatttacaccttttttcttcagatatccaagtacctttttatactcatgcggataatttgccaaaaatgcaggagctaaaataacagaaatcttttttcctgcttctaatgctgtaaaaaatgattttgtgtcatcctgatattctctggcattatgctcacatgcatcaaaacatgccccacatgcaatacatttttcagagtcaactgttacctttcctgcatctgttgcaacattggcgatcagcaccggacaatctcttacacatttgttgcatccggtacaattatcatttgcgtaaataagttccattttgtccacccgctttgtataattttcacaaaaaatatattgttatagtgatattttatcatatttttgtgttaataacaattttttatcacttatttttttgaatgtttataaaataatatacaaaagaacagaccgctttgagcagcctgttcttttgttcttctaattgtacttaaattaaagaataatcttcttcggacatttctgtgcacagataccacatccgacacatttttcctgatcaatatatgctacattgtcaatgacatgtacggcatccttcggacagttcttctcacagagatgacatccgatacatccaacggaacatgccttcattacattcttgccgacatccttagaactacactgaacaatatgttttgctgagtaaggaaccagctcgattaagtgtttcgggcaggcagccacacatttaccacatgccttacatacttctttatcaaccagcgctataccatctacgatatggattgcatcaaacggacatgcctttacgcaggagccaaaacctaaacatccatagttacatgcctttggtccaccgtttggaacgaacatcatagatgcacaatcctcattaccagtatactcgtaatctttctgtgtcttgtcacaggttcctgcacattttacgaaagcaacttttttctcacctgcacctgcatctacacccatgattgcaccgatcttagctgcaactggagctccgccgaccggacactggttgactggtgcttcaccttttgcgatcgctgcagcaagtccggaacatccggcataaccacaaccaccacagttatttcctggaagttcgcctaagatggcaacttccttctcatcaacttctactttgaatttttctccggaaataccaaggaaaaatccaatcaagatacctacgccgcccacaacaagggctgcaactaatattgctgtaacgttcatcttatttttcctcctaaatcattcctgagaatcccataaacgcgatagacatcaaagctgctgtgatcagaacgatcgcagtaccctgaaatggttttggaatatcattgtattcaattttttcacgcagacctgccatcagaacgatcgcgatcaggaatccgaatgcagttgcaaaaccatttacaacactctctaagattccatattcttttgtaacgtttgttaatgcaacacctaatacggcacagtttgtagtgataagaggaaggtatacacctaaactctgatacaatgccggcattgatttctttaagaacatctcaacaaactgtactaatgctgcgataacaagaataaatacgatcgtctgtaaataagtaagatcgatccccttgctcatcagatagctgtttgcaagaataaatttatagatcagtgctgttacaaacgaggaaatcgtgataacgaacacaactgcaccgcccattccggctgctgtctctgttttcttggaaactcctaagaacggacagataccaaggaactgacttaatacaacgttatttacaatcgcagaaccgattgcaatcaaaagtaattctttcatctgtacctatcctcctactcttcttttccggcagcatctgcttttacagttgctttaccgctgcagtgtgcagcctggctgcagccggagcagtcgccgctcaagcatcctgcaggctctgctaacggttttccttttgcttccatcttcgctcttacaatgttcataatagcaaccagacaggacaatactaagaatgcaccaggagccataacgaaaattgtgatcggtgtaaaccattttaaggataagatctggaatccgaagatctgacctgctcctaaaagttcacggatcaaaccgatgcaggtaagaccaaatgtaaatccaagtcccataccaataccatcaaacatagacgggattaccgggttcttagaagcatagctttctgcacgtccaaggatgatacagtttactacgataagaggaatatatacacctaaagactcggaaaggcttggtgtatatgcctgcatgataaactgaaccatggtaacaagtgatgcaacgattacgatgaatgccggcatacggacaccatccgggatcactttacggaatgctgaaatcagcatattggataaaataagtaccactgttgtggaaagtcccataccaagtccattgattgctgaggaagtaaccgccaatgtcggacacataccaagcatcagaacgaaggtaggattctccttgataataccgttatataaacgttctacatttttgttcattaatttgtacctcccgctaaaacattctggaagtatgtcaggcaggcatttacaccgttagccatagcttttgatgtaatggtagaacctgaaattgcttcgatctcgttgtcggctgacggagctgacttaacaacggtaaaggaatctacttttttgttttcaaactgaccgtagaaatcttcttcctgcgccttcataccaagaccaggtgtctcagaaatagatgtgatggaataaccatttacagttccatcattctggatacctacggagaatgtgatagatccctggcttccgtcctttgcggttaccgtaaatacataaccaagtgtattttcggatgcatcctgtgctgcaactactgtctcgatctcatcggaatatccgttttcatctaacagagcctgtgctgcgtctgcatcaaaatctgcataatctgtaaaatgatctgcatctgtaaatacctgtttgtaggcattctgtgttttttcttcatttaccttgtcaattgaaggttttgtgacaccgtacacaactccaagtaaaagtccaagtacgattgtaaaagcaaataaaattaatgcgtcatgaacgatcttcttattcatcttatttgcctccttcctgctttttggcttcttttaccataccaaatgctctcggaactgtatatttctcgatcatcggaactaagatattgcttaagatgattgcaaaagaaacaccttctgcatttgcaccaaagcaacggaacagtccggtaaagataccacagcagataccaaagatgatctgtcccattggtgtgatcggtgaagtaacataatcagtagccataaagaatgcaccaagcatgagaccaccaccgcagagctgtgctgtaatataagtccagtcagcaccatgtccgctgaaaagaagcatgaaaacaataaatgtgataatatagcttgccgggattctaagatcgataacacccattaaaatcaggaaaattgcaccaatcagaatcgcgatcgcggaagtctcaccgattgttccggctgtacgtccgatcagcatatccatcgtattgaccggatcaccatttctcattgctgcaagcggcgttgctccggtataggaatcgatcgtaaagttcgtcatgttagctgcaaatgcaatcagaagaaaacatcttgcacccagagcagggttcatgaagttctgtcctaatccgccgaacatacattttacaaccacgattgcaaatacaccgccgagtactgcttcccaccatggaagtgtagccggaaggtttaatgctaaaagcagaccggttacaacagcacttaaatcattgatcgtctgttttttatgtacgatcttattgaagatccactctgatgcaacacaggatgcgattgttactaaaattaaaatcagtgctctgtatccaaagttataaataccaaataaggttgtcggaagcaatgcaataattacataaagcatgattctttccgtcgtatctttagaacgcacatgtggtgatgatgaaacatgatataaatcactcacaggaatccacctctttcttcagttttaaaaatttatttttcatatttccattattttttgcgttttgctgcaagaacctgttttttcatggtcttgatagactgtgcaagctgtctcttagccgggcatgcaaaactgcagcttccgcactcaacacactctaagccatgccatttttcaaattcttcggaaagtcccttatctgagaacttcgcaagtctcgacggaatcaactgctccggacatgcttctacacagcgtccacagttgatacatgctgtctgtaacttttctgcagcagcaacctcatcctgtgacatacataacagggaggatgatgtctttgtggtcggaacgtctaatccaaacatggcaaatcccatcatcggaccaccggaaataatcttctcaggctgtactttaaatccacctgccgcatcgacaagttcctgataactcgtaccaatattatataaaaagttacctggatgctctaccgcatcacctgtgatcgtagaaatacggtttgttaccggcttgccaagtttaactgcattatagatggcaatgatcgtctcaacgttgtcaacgatgcatcctgcatctgccggaagcattttggaattgatggaacgtcctgtcacagcataaatcaactgacgctcaccaccctgcggatactttgtttctaatggacatacttcaatacgcggttcatcctttacaagttcctgcagtttttcaatacagtccggtttgttattctcaataccgaatacaccctttgccttgtcaaaaatctgaagaatgatcttcatacctccgatcagctcttccggattttctaacattctccgataatctgcggtcagatatggttcacactctgcacagtttgcaatgatatactcaattttttccggttcttttggtgataacttcacatgagtcgggaaacccgcacctcccatgccgacaacaccggcctcttttactttaccaatgatctcttcttttgataaagctgtcacatcttcacatggcgtataagaaacctcttcgaacgctccgtcgttttcgatcacgatggaattgaccatatcgccaactgccacacgacgcggttcaatagcttttacagtaccggaagcagatgcataaattggagatgatacaaaaccgcccgcttctgcgattttctgtccctttaatactctgtcgcctttcgccactatcggacttgcaggtgctccgatatgctgtgataacggatacaccaggtcgcccttgggtaaaacttccacaatcggcgcatcctttgctaattccttgccttcgtaaggatggacgccacctttaaatgtctttaaacccatttttcgtgccccactttctcttaattgtattctattctatgatatatctcatagaacatttatcctattgattataccacaaaatgatacatattccatctattccttgtattttttttagaaccttttgacaaagttttcacaattattgagataattccatcaattaatggcattttctttttctttttatatgtgataaaatagtttattatgaaggaaatcagggaggatttatatgaaacactggcacgaagaaatgccttttacagcagataattcactggcagaactgatatttacagagaattctcttttttttgatatagaaacaaccggattttcagctgcacgcacatcactctatctgatcggatgcgctgcgcggaaagaaaatctgcttattgtcgatcagttttttgcagaaactccggcagatgaatcggatgtactgcatgcatttttggattatctgcaaaattttgatacgatcatcacgtttaacggaatcggttttgatattccgtacctgacaaacaaatgtcagaagtacaaaataccagaaccattttccgcttatgaatatgttgacatctataaaatgatctcaggctttcgttttctttttgcccttccaaatttaaagcagaaaacggtagagcaattcattggtttagaacgcgaggacgcatataacggtggtgaactgatagatgtatacaaggcatgtcagaaaaatccagataaaaaacttatctctcttttaaagcagcacaattatgaggatgttatcgatatgccaaagcttctctccgtactgtcctatgtaaagctgtttgagggcgcatttaatgtgacatccatctgtgccaatgaatctgtctcctatgacggcaaaccctgcagggagattctcttttccatgcaaaacatttttccggttcctaaacgtgtttcctgtcattatgaggatttccatctggttgtcgatacagaccagacaacactctgtgtccgtttatatacaggggaactcaaatattttctttctgattataaaaattactggtatctgcctgaggaagatctcgccattccctcaagccttgctgcctcgattccaaaagaacgaagaaaaaaagctaccgcaggaacctgctataaaaaaaagaatgccatttttgttccccagtatcaggaaatacaaaaaccggcattccgtcttatgtttaaagataaaaaaagttattttgaactgtcagaagattttgttgcttccagtgaaatgcagaaagaatattgtatgcatgtactgcagtttatctgtaagaaaaaactgtaagctgccatccattccttttataatctgatctggccagccttactccatgcactgtaaacctttttgccatctgccagcttatatgttcgtatctgcacataatacaccgcattatttttcagtttctttatttttaatgtggtgtttttatttctggtaatcacttttttctgcacatttttcttcatctttgaatcagtactataacgtatctcatatccggtggcactatctgcttttttccaggatagctctatctccccggcgtttacgctgacacttttcgtaaaagatgtttttttcggtaatattttaaatgtttttgtgactgttccaatatacgcaccttttccactgacgatcactgttgcaatgccgctttttttattatttttatacttcacggtataatcagtgccttgttttaattttttccctttcaatgtaaccgtcacagacggtttcttcgctttgccatcgtatgtataagtatttttattgagtgtacattttgctttttttatgctggctaaattatccggattttcaaattttatatgaaatgtctgataccagccattctgaacatcatattcataagaaaccgtgtttgtttttttatccgtcagtgtaacaacagaaccatatcctccatcacttctggttcctcctgttacttctccaatctttgacatatcaaatcccggcaattttgccagatcgatctttttccccttttcaactgtataatactgattatcaaatttataccatcccagccctgatatattactaatatcaaaactggtaagttcattaccgttcagctctatattggtcagatttgtagattttctcaaatccaaatatttcagtctgtttttctggcagtctaatgtacgcaactttttattttttgtcacatccagtttcgtaagattatttcctgcacagcgataggtaactaattttttaaatttggatatatctatgcttccaacccctgtatatgcaacatcaagctctgtgagattcacacatcccgtcaggttaaccgtttttaatttcggtgccttatgacatgcaaacgttttaaggtttttacagttgctgagattgattctttcaatattaggaattacaggatcaacatatgttccatagccatatgcggcaaattcagcctcttttaaatacttattattgctcagatccaattctcttagtttctcaagtttttcaaatcgatccacgtcaaaaattttcaacgatgtattcacacattttattttttctagtttcggtgcctctccctcaaaatacacttcctcaagtttgttatatttacttaaatcgagactagtcagcagtaaattttcaaaagttattttttgtatctttttcggcaattttaaatcagtcagtttaccggcattcagttctaactctttcagtttactacactcctgtaaatttagcttttttaaacctccagaactgatccgaagatttttcagacctttacagccggtaaaatctatatttttcaggttatcctggtctaaagtatcaaactcagtcagcccggaacatcctgacaaattcagggttttcaaataataatcttcaatatccagtttttcaagattcgcacatccgtttaattgtaaattttccgtggagccttctaccgaaaactcttttaaatttttataattacttaaatccagtttttttgacgataccccctcaacatgaactttttgaactgattttggaagtacaaaatcttcactcagttttaccgctttcaacgaaagttccaaaatcttctgttggctgttcaaatccagtttagcaattgaacttctatcctttccgtacagattttcaatgtcaagctttttcagtgcaatacaaggactcagatctaatgcagctcccatatattcttttattgtcagtgtttctaatttttggcatcctgtaaaatcaattcctgcatccaaatctatacccgcatctatagaaaggctttttaatgcggtacatccagaaaacgacgcaactctcaaatgatcgactttataagcatccgatatctctatctcttccaacgaactgctgttcataatactgcagataccatctgtcaaaacaatttttttcaggtaccgtaaatattctattccctccgtttgtattttttcctcaaattccagctttgtaatcttcctgttttcggaatctgccaagagaccatctttattggtgtcatatttcttgatttttttgcgaaattcatcatccggaaaattcatttcattgatcgctacactgccatcctgatgaaatccttcatccagttccggctcgtccggtttctccggctcttctgtcccatcatacaccatccagacactttcttccgcttcttctgtatcatcagcatccatgatttccccggtctctgtctcagttgtctgctccgtatttttcccggtttccgtctcctcggttgtctgctccgtatttttcccggtttctgtctcctcagttgtctgttccgtgttttcttctgcacccgtcccggttatctgctccgcagtatccgtttctccaccgttctcatcaccgtaatctgcaaaaatgctctccgtggtctgtgtattttcctgcgcacaaatgtgtacgctttcctgtaagctaaatatcacacccacagccagtccaagcgacaatattcttttatatatttttttcattttcaacctccaaataataaaacagcctatcatttcctgataagctgtttttaattatgtactgttactttttctcaaagaagaaggatgtatgtctgtcaaatccaagttctctgtaattcatgatctgttctgtactgccaatgaaaagtacaccacccggctgaagcgctttatggaacttctgatagatcacatcttttgcttcttccgtgaaataaataaccacattacggcagacgatcagattgcagccactcggatatggatcttttaacaggtcatgctttttaaattccaccctttttttgatctcatctgaaatctgataggaagaaccaacttttgtaaaatacttctttttcagatcatccggcacagaggcaatactcttttcattgtacagtcccattctcgccgtatcaagcacctgattgtcgatatccgttgcaatgatcttaatatttgcaagcggaacctgtcttgaaagtgccatgacaagggaatacggttcatctcctgttgaacatgccgcactccagattttcaggttcttgccaaactttttgatcagttccgggaatacctgtccctctaatatcttccactgatccggattacgatagaattcagaaacattgattgtcaggaaattgatgaactgatcaaatttttctttatctttcttaatcagtgctacatagtcattgtacgtcttaacgttgttcttcgtgatcagcgtattgatccggcggcgcatctgtttttccttgtaagaattcagatcaattccggcaagctgcaaaatgtcctttttaaatttttcataattatcggtttccagcataatctactttcctcctgtttccttttgcacaaaagttctgtaaaaccagatttactttcatgccatatcaaaaataggctttacacattccgtgaaagcctatttttatccatattactgtatacggaatttagttctcttctgctgcaactgcatcgatatcgacatctgcaacatcagcatcttctgactcatttgtctccggagcaagtaatgctttgatggaaagactgatcttcttctcgtcctcgttgaaatcaacgatcttagcttcgatctcctgacctacttttaatacatcagatggtttctcaatatgctcttttgcaatctgggaaacatgcagtaatgcgtcaacacccggagcaagctctacgaatgcaccgaaatctgtcattcttgccacttttccttttacaacgtttccaaccgcatatttctctgcagcaccattccatggattctctgccgggaatttcatgctgagtgcaatttttgtatcgttgatatctttgatgaatacacgcacatgatcaccaacattaaatacttttttcggactctctactctgccccatgacatctcagagatgtgaagcagtccgtcagctccgccaaggtcaatgaatgcaccgaagtctgttacatttttaacagttccttccataacatcaccaactttgatctttgcaaacagctctttctgctgctctaatttcttagcaactaaaagctgttttctgtcgccgatgattcttctgcgttttggattgaactcgctgatcacgaactcgatatcctgatctttgtacttggataaatctttctcatagctatcagatacaaggcttgccgggataaatactcttgtttcatccacgatcacgcagagaccgccgtctaatacctgtgctacttttgctgttaatacttctttgttttcaaatgcctcttctaatctcttgctgcctttttctgctgcgagacgtttgtatgtgagtaatacctgtccctcaccgtcatttaccttaagaacctttgcttccatggtgtcgccgacagataccagtgttgttaaatcaacgttagcttcgttcgtatattcattacgagtaatgattccgtctgatttgtagccgatattcaatacgatctcatcaggttttacatcgataacggtaccttcaactacctctccatttcttattgttttaaatgattcctccagcatttgttcaaagctcatttctgacattcttttgaacctcctcaataattttgtttggggtagaagcccctgcggtaatacctacgctatcgatggactcaaaacatgtgatatccaaatcttttacagtttgtatatagtaagtattgttgcattcgtttttacatatttcaaacaacttctgcgtattggaactatttctgccccctatgacaatcatggcgtccacatcacgggcaatctttgctgcctcagtctgtctttcctcggtggcattgcagattgtatttaaaacaattatatcataaccttttttatttataatttcaactaattcttgaaatttattgtaattaaatgtcgtttgtgctacaatacatacctttttcccagattctgcctgatatttttctgcctcttccggggttgcgatcacagccgtatgcggatcaagtgaccagcttttgattccttgtacttccggatgcttttcattcccgataattacgatctgcgccccttcggcactgtgtttttccacaaggcggtgtatctttaacacaaacgggcaggttgcgtccaccaatgtatagccaagttcttttattttttcagatatgcccttttccactccgtgtgcacggatgatgaccgttccgccatgcgccgccctctcttcgagttcttctacgctctctaaaacagtcactcctttttcttccagatcacgcaccacctcttcattgtggatgatcggaccaaatgtatagattggctgtctctctgcggcactcatttcaagctgctcatacacggtatcgaccgcgcgctttacgccaaagcagaaacctgcactttttgccaatgttatcttcatattttatgtttccttatcttgcctctgaataaacctgataaatggcatctaccacttcatcaatattcatttccgaactgtcaaccaaaacagcatcctctgcctgacgaagcggtgatgtttcacgatgcatgtcacggtaatcacggtcaataatatctttttcgatctctgcaagatcacagcttactcctttttccgtcagctcatcgtatcttctctttgcccgtgtcgcagaacttgctgtcagatagattttgacctgtgcgtccggaagaacacacgttccaatatctcttccatccatgatgacatctgcagactttgcaagctgacgctggagttccactagctttttgcggaccaccggatagacgcttgtggaagatgccatatttccaacttcctcattgcggatcacaccatttacattctctccatttaaaagtacctgctgttctccgttttcataagtgatcgtgacatccacgtccgggcatgctgccgcgatcgcattttcatcttttgcatcaatgttatgctgtaaaaaataataggccatcgcacggtacattgctcccgtgtccacatagataaatccaagttttttcgccagccgctttgcgatcgtgctctttcctgctcctgccggtccgtcaattgcaatattcatactcatgttttattctccttttacattttgctgtgttttttatttcctattcttttgtccataacaatccatagatttataacgctttatcatctgttatctttcatccggctgcgccgctgagattcccgcaagataaccggtggaccatgcaatctgtaaattataaccaccagtcatcgcatccaggtctaacacctctccgcaaaaatataaatgcggcaccagttttgattccatcgtagacggattgacttcttttactttcacgccgcccttcgtgatgatcgcttcgttaaaatcacggagtccacacagtgtgaccgggaatgccttgatcagtccgataaaatgtctgcgttcctctttggtgatctcattgacctttttctccggatcgattccgctaagatccagcatgaccggaatcattttagccgggaaaagcccaccaatggagtttttgaactgcttgttcttcgcctcatcaaactctcttaacagacggtgatctaactgttcttccgtaagtgccggctttaaatctataaacatagaaagttctccggccgtaagagacggtttgatagctgcactcgccgataaaagcagcggcccgctgacaccaaagtgtgtaaacagcatctcgccaaactcctgatacagcagttttttttcatttaaaatgcgtacttccacattttttaatgaaagtccctgcatctgccggacatagtcttcttttgcgagaaacggtaccagtgacggccggatgtccgtgacggtatgtcctgcttcttttgcaaaacggtaaccatcccctgtagagccggtcgtctgataggaaaatccgcctgtcgcaatgattactgcatctgccggcattgtggttccatctgtcagctttacgcctgtgacaatgttttccggtgcatcttctccggatgattccataagcagactttgtacctgtgtatgcagcattacttttacttttttctctttcagcactttctgcaatgttgcgatcacatccgaggaatgatccgaaacaggaaatacccgattgccacgctctgtttttgtcctcagtccgtttctctcaaaaaaatcaatgactctttgattgtcatacgaataaaaggcgctatataagaactttgcattggtcataacatttgcaaagagattatccatatctcccgcattggtaatattgcatcgtccctttccggtaatgaaaagttttttcccaagtttttcattcttttcaagcagaataacctgactgccggtttccgctgcggcgatcgcagcaaacattccagccggtcccccgcctattacaatgattttattcatgaaaatcgctgtctcctatttttgcataacgcatttttatggaatcgtcaatcacattgatctcatcattttcatagacctgatactcatcccagattccttctaacatttctaatgttttcgcaacatctctctgttttttcatacagagtgccacgatcagggcattgatcacgctgagtggtgcaaccagtgaatcaacaatagacgccatatcactgtctgcgatcagattacaggacgaatacaaattcatcggtgaatgcacactgtctgttaatgtaatcacttttgcactgcggttgttggcaaactccatagcctttaatgtacgcatggaatatctcggaaaactgattccgataattacatcttccttaccaatacgaaccatttgttcaaaaatttcactggaactgctcgtctgtatcagacgtacattttcaaacatcagtgtaaaataaaatgccataaacgacgcaagcggcgcacagcttctgattccaataatataaatatgtttcgcattcaaaatggtatctactgccatctcaaatgccgcctgatctattttttccaatgtgctgttgattttttccgcatctgactttaaaacagattctaaaatttttgactggctgatcctgccataagtaacttccatacgctgaatggagtttaatttgttgcgtaccagttcttctaaggcactctgaaattcaggatatccccggtatccaagatgcatggcaaagcgcacaaccgtggattcgctgactccgaccacctcacctaattttgccgccgtcaaaaatactgccttatcatagttatctgtgatataggtggcaagcagtttctgtcccttgctcaatttactgtatgactcgttgatccgattactcaaatcattcttactgcccataacccctcgttcctgtcattttatgacaccgtctgcaatttatgatgtgcctttgcacaccaacatttctattatatcaaaacttttcctttttgtcagctttgaatcattttcattctgtaaaattcaccttttcgtgccatcagctcctcaaacgtaccatattccacacaatgtccgtccgcaagaacggcaatcttatctgcatcacgaattgttgacagccggtgtgccacaataaatgtcgtcctccccttcgtcagattttccaaagcttcctgtatcagtttttcagaaatactgtctaaagccgacgtagcctcatcgagcacgatcacctccggatcacggatcagtgctcgcgcaatcgcaatgcgctgtctttgtccaccggaaagttttcctccatgttctcctaccatggtatcaaccccatttggaaggctctccatcagatccgtaagatttgccgcctttatgacacgttctaattcttcgtccgaaacatgttcgtttccgtaagtaatgttttcacgtatagtccctgaaaataatatggatgtctgtggtacaacggcaagatgttttctgtatgtacgcagatctattttcctcatatcattaccatctaaaaggaccttccctccgtccgccaaatgaaagccgatcacaagatttaacacagtcgattttcctgcacctgactccccgactaatgcgatcgtctccccctgttttacatgcaggttcaggtgatttaacaccggtttgtcactgtttttataatgaaaggaaacatcttcaaaatcaaatatgccagttacgtcctctaactgctttttcccctcattctgctccacatcctctgagaggagcacctcaccaatggaattgacagattcaatgcctttcgcgattgtcggaagcaatgtaacgattgcagacacctgattgaccaccgttgcaaaataactctggtaaagtgtgatatctcccgccataatgcgtccacgcaacgcaagatagccggtaaatgccagacagacgacctgaaacacctggaataccgcccatccgactgaaccaaataatgcctgtaccagatccagtttatatcccttttccgccactgtaaaaagctgtccgctcatcttatgtacttcttcgtcctccaatgcgtgtgcccttgtcaccgggacaagttccaccatttccatcacacgcgcagatgtttcttccatttcttttcgaaattccgtatttctttttttcatgaccgagcggaacgaaaccatcgtgattgccgcaaccggagttgtcaacagaaaaaatacaaaaacgatcttactttttgatgctgtgaccaccagcgcaaccccgatattcagtgcaatatttaaaatgcttaagaacatctgtgtggaaagtgtctccaccgcctccacatcacgcataatcttagactgcagccttccagactgtgtctccacatggtaggcgatcgacaactgctgaagtttccggatcaatgccttacgaagtcctgtttctgcgtaacgtgttgcaaggcttttatatgatgtatacagataattcattggtatattaagtgcgatcaaaccaatctcaagggctgcactgatccagatatttctcacagtatcaggattcttctgtgtcacatcattgatgatatttgcagttatgattggaagtacccacacacatgcatgctttataaaaaaacagataactgccataacaaatttatgataatttcctttgtacagtgctatcagaatccgtatcggatgacctttatatctgcgataactttctataaaccagttttctgtatctatgccatttttcggcgacgttttccgttcaaaattttccattttcttatatcctttatcatttataggatgattctaattcttttctttgtaaaaagcaatatttcagcaaaacaaaaaatgccacagcagcatcctaaaatactgccgtggcatttcatcaatcatattctaattataccggatatgcaccattctttgtatctgcaattgttgcatctacttttttctgctgtgcttcacggtatttgaagaactcagttgcaacctgtgggaacaatgcgtaagataatacatcttcatcctgctgtttccactgtttcatctcagcttcaatcttgtcaagctctggctctaacagatctgccggacgacaggtaattgcattcttcttctcatcgcctaatactttgtcaacaacttccggattgaacggttttacagtctgaccgtattttccaaggagaacatctttcgtctctttggtcgctactttgtaacgctcacccattaatacgttgaatacagcctgtgtaccaacgatctgtgaggaaggtgtaacaagcggcggctcaccaagatctttacgaacacgcggtacttctgcaagtacttcctcgtatttgtcctctttcccctgctcttttaactgggagatcaggttggataacataccacccggtacctgatataataaagtcttgatgtttacacctaatactttcgggttcatcagaccactctctaatgcttcctctctcatcgggcggaagtaatcagcgatctcagcaagtttgttctggtctaaaccggtatcaaactctgttcccttgaatgcctctaccataacttctgtagccggctgggatgttccaagtgcgaacggagacattgcagtatcgatgatatcacatcctgcctctactgctttcaaatatgtcatggaagcaacacctgatgtatagtgtgtatgtaactctaacgggatatcgattacttctttgatcgcacgtactaactcgtccgctttctgtggaactaaaagtcctgccatatctttgatacatacagaatcagcgcccatatcctctactctttttgccatatctgtccagtaatctaaagtataagcatcaccgagtgtgtaagataaagcaacctgtgcatgtcctttttctttgttacatgcgcttactgctgtctgaaggttacgaagatcgttcagacagtcaaaaatacggatgatatcaataccgtttgcgatagatttctgtacgaagtactctaccacgtcatcagcatatggacggtatcctaagatattctgtccacggaataacatctgtaatttcgtatttttaaaaccatctcttaatttacgaagacgatcccatggatcctcttttaagaaacgaagggatgcatcgaaagtagcgcctccccagcactcaacagcatagtatccaaccttgtccatcttatctacgattggaagcatctgctctgttgtcattcttgttgcgatcagagactgatgtgcatcacgcagtactgtctctgttatttttaaaggttttttaacaacttcagccattttttcctccttatacagcgaacctgtttttgttctgccgtctgattaaattccaaagattgccatgaatacaccggctgctactgctgtaccgataacaccggcaacgtttggtcccattgcatgcataagtaaaaagttcgtaggatcttcctctgcaccaactttctgtgatacacgcgcagccataggaactgcggatacaccggcagaaccgatgagtgggttgatcttgccttttgtaatgaagcaaagtaatttaccgaacaatactccggctgctgtaccaaacataaatgcaatcagtccaagtgcaacgatctttaaagttgttgcatttaagaaagcctctgcacttgtggatgcaccaacggatgtaccaagtaagataactacgatatacatcaatgcattagatgctgtctcagataactgacgaaccacaccacactcacggaacaggttaccgagcattaacataccaacgagcggggctgttgtcggaaggatcagacatacgacaacggttaccacgattgggaataagattttctcaagtttggataccggacgtaaattctgcatcttaatggcacgttcctttttcgttgtaaataacttcatgattggtggctgaatgatcggcaccagtgccatgtaagagtatgctgctacagcgatcggacccataagaccggactgtccaagttttcctgcaaggaaaatggaagtaggaccatctgcaccaccgatgatagaaacggctgctgctgctttatcattgaatcccatcaggattgcaaggaaatatgcgccgaaaataccaaactgtgctgctcctaaaaggaagctgatcgggtttgcgatcagaggtccaaaatcggtcatcgcaccaacgccaaggaaaataagggatggcaggattgaccattcatctaaggtataaaaataatggaataaaccaccgacaccgttactcatctgttccggagttgcaaagatatccggataaatatttaccagaagcataccaaatgcgatcggaacgagtaacaacggttcaaacccttttgcaatagccagatacaggaaaatacatgcaactaagatcattacgaaatttccccatgtcaggttgaaaaaggcagtctgatgaaggaggttgcccattgtctcagtaaaataactcattgttatcctcctaaaattagttgtttaaagttgccagtaatgcacctgcttctaccatatcaccaacgcttacgttgatgcttgctacagtaccatcttcggtagcaacaaccggtgtctccattttcatgatttcaagaactaagattgtgtcacctttctttacagatgcgccaacagaagactcgatcttaaatacttttcctgctgcacctgcttcgatctttacgttacctgcgccacctgccggtgctgctgccttcggagctgctgccggagccggagctgctgcacgtctcggtgctgctgccggtgcacttacagcaccattctcttctacagtaacatcataaacatttccatttacggtaattgtatagcttttcattgaatcatcctcctgtgatcattacttttttacgacatatatttattataacttgtctgcttcgcctatcttctatggatagaacgtactacgaatccatctgctgatgttccttctgccgctgcgattgctgcagaaataactgcaaccagttctaaatcatcagtaagctgggatgtctcctcacgctgctcgatctgttctacaaccggatctgccacatctttcttcgcaccagcatttgcttttttgttctgtaaatacggaatcactttaaagcagctgatgatcagactgatcaggataagaactacaaatacggttcccattcccatcaatgtattcataccggctttttccattttctcgccaagtgaatacacaagatctgcacttgcatctgtaagttccggtgcttctgtctcgtaattgtattcatatacataagaaacaactacatctctgtctgagaaatgtaaaacctggtctgcagtcacagtcttctgtgcttttgtcacagtaagatctccaagtccctgataggaacccagatctgaaactgtttcaccccaggatgtcagtaagtgggcaaatgcatccattccgtttgagtcataatattctgcaccactctgtatatcttcatctgaaaacgaaacaagcgcagatactgtctgctccatgttatcctggatatcagaataactcataccaaaataatcaacgctcttaggatccgttccacatgctgtcattgccagaaccataaagcaaagacaaagcataagagataattttttcttcataacttcacctttctattttgttccatgtttcttgtccggtacacctgcacattttgtgtataataattcaaatgcatctacaaggtattttctggtgtctgccggatctaaaataagatctacataaccacgtcttgctgcagtcataacacttgactgtaatgcatcatattcttttgcttttgctgcgagttcatctgcagatgcatctgcgtacatgatctttgctgcaagctcgccatccatcataccgatctttgcatcttcccatgcatatgtaaagtctgctccgattgctttggagttcattgtcacataagcgcttccgattgcatttccggtgatcaggtttactttcgggcaggttgcatcagcgaatgccattgtcatgcgtgcaagtgcttttgcaagtcctttttctgcacagacagtagctgcataaccttttacgtttgttaaagacaataccgggatctcgaacgcatcacagaagttaacgaactctgctgccttgttgcatcctcttgctgtcagagctccggagaactcctctgcttttttgccctcttcatcgtaaacttctgagcagtttgcaacagcgccgactgtcattccgtttaactggataaatccggttaccatatcttttgcatagtttttctttgtttcaaagaatacatgtccgtctgagatctcacttaataaatatcttggatcgcctttcatggctgccatgttctcacatgcacggtttaaatcatcctgacactcagatgtgtatacatttccttcattatttaaaggaaggacgcttactaactcgcggatctctgcaatgatctcatcctctgttccaacagcatcgatacaaccgtttttctcactctggaactctgcggaagaagtatcgcatttttcaatacggttaccctcgatcgcattcggggaattgatgaacatttttcctttgctctccataaatgcgaaatcagataatgcaggaactactgcaagtccaccgccacagcttccgaaaatagcggaaatctgcggaacaacgccggatgctgcaacctcctttgcgtagatctcaccaaatccgtttaacgcatccacagattcctgtaaacgcattccggcgcaatcgataaatccgatcaccggtgctcccattttcattgccatgtcatatacggctgcaatcttctttgcatgcatctctccgatagtaccgtttaatacagctgcattctggctgtatacaaataccagattgccatccaccagaccatgtccggtaattacaccatcggacggtgtatctgtgtctgcaagattaaagtctgtatttcttgcggttacgagagaaccgatttccatgaaactgttctcatcgactaacttggtaatacgctgcattgccaagctatcattactactattcatcctttttgccctccatctataaagtttgttaccacatcttttgacatggtacatagtgaataatgtaaaaatataacaaattccgctaggataaattatagatggtcagtgacaaattttcaagagaattgttaattttttgacagtttttttttgcatacaaggaatttagggcttttacattggaaataattctgctgttttttttacacaccagcaaaaatcgattctttttaccgtattcttcactgtgaccacacgttttgccagaacctcatctcccagaaggtatgttatctcaccgataaaatctccttccgttaccggtgcataaagtttccgggataattgatactctatgtgtacttcctggtctttttcgatcaatagttccacattttctttcaccgacgcaacttcaagttctgtcgttacctcttcgccgatctttgtgccctgtccgtccaccacctgtaccggagcacattcccctgcgtccagttcaatctcatccagacttattttccggaaccgggaaattccatactgcataagtttttttgtatctgcccacttatatgttttgttattcggccacccgcaggcaagcagtgcaacgataaaagttctgtcatcacgttttaatgccccgacataacaatatcccgcattaccggtaaaaccggtcttgcctgacaatgccccgtccatcatctgcaaaaatgcattatgattacagcaggtgtaactgtttttaccatctatatcagaaaactgatactgtccttcccttgtgattgtaagaaattgctctgccatttctgatgttttgatgcagtaccgcatgatcaaagaaagatctgccgctgttgtgtgatgaaagccattttcatttttggcatccagtccgttcggtgtgataaaataactgtcctcacagccgatctcctctgctttatcgttcataagttttgcaaaatcacccgtcgtgcctgcaatgtgttctgcaatcgccacagcgcagtcattataagattccaacatcagtccgtacagcagatctttcagataaaacttctgcccctcccgcatacccagatgaactttcggctgtgacgctgcaagcgtactcacggtcacttcgctgtccaggtcgcagttttccagtgcaatgatacatgtcagtattttggtcgtactggcattcgccatcgcctggtgcccgtttttttcatacaggatactcccggaatccgcatccataagcacagctgcttttgcatacagggaattttgatccggcttttctgtcacttcctccatccgcacattttctttttgatcaaaagcctccacgatctgtatcccatatcctgttaagatcacagtgacaaggatccatgccagcagttttttccacatacaccagactccaaaaaagcatttcatcaatccttatgtatataatacgcaaaaaatgctcattttttgtgaaaaaaagcatacgaaaccagatcagatatccagtttcatatgcatttccgcttccgcttcctgtttgaattcttctacctggaccggacttaacacgggaagttcatcgattgactgaacgccaaaactccttaagaattcctccgttgtgccaaaaagcagcgggcgtcccggcgcatccagccttccaagttcacataccagattgtactccaccagcttatttaccgcatgatcgcaggaaacacctctgatcttttcaatttccgcctttgtaatcggctgcttgtaggcaatgatcgaaagggtttcaagcagaacgtcggtaagcacatgctttttcggctgctttgcgattttcaccagatattcatacatttcgcccttcgtacacatctgataagaaccgtccagttccatgatcttaacgccgacgccgtcatcctcatagcgctgcatcagatgttctatgatcttttttgtccgttctgtatcaagttccagtgtttttgctatacgctctaattccacagactctcctattgtaaacaggatcgcctcaacgattgcctcatattttttttcttccataccaaccctctattccggtgtgtaaaaattccacacagatcccatttcatttctgctgtcacacagctaggccgcaatttttgattcaatttttatatcatcaaacgtgtattcctgggaaacaacgatctttcccatcttcatcagctctaatattgccagaaatgtcacaaccacttccattttcccggactgtgcttctaaaagactccgaaacgaaaaatgtccgtgatgcagactgtattcttccacatatgtcatcttatcagaaagtgacacttcctctttctcgattcttccaaacttcgaacggaccggatcgatcttatccgcctgtttctttatgatggactgaaaaatatcattcagcctcgcaagtgttaccccggacatcagttcattcacatcaaccggttcttcatatgcaagaacttcgggcgggattgtcggtgctttaaaccatactttttccgcatcaatctgacggtccctgagttcatatgccatacatttatacattttatattccaacagctgctgcacaagttccgctctcggatcttcttcttcatcatcctcgctttcttttgcagggagcagcatttttgatttgatatcaagcagtgtcgccgccatcacgagaaattcgctcatcacatttaagtcctgtctgcgcatttcggcaatatattccatatactggtttgtgatctccacgattggaatatcatatatattgactttatttttttctaacagatgtaaaagcagatctaacggcccctcaaacacctgaagttttacagttaattccatctatgtcataccctctcattccacaaatattgattttaccgtggattcccgcaaaattcaagatttttatgcataatgtacatccttcgcatctaaaataaattataacagaaccctacggagggcatattcttgaaattcatggtttccattctgctcggtctcaatctccttgtgcagggcacggtacttcctgcatcttcctgtttcattccgaatgtaaccatccccctgtctcctgctgcccagacagatactgcacctgctgcagacttaaatatctccgcaccaagcgccattttgatggaggctttcaccggtgccgtcgtctacgaaaaaaatccccacgaggcaaggcatccggcaagtgtcaccaagattatgacgctgcttctgatctttgatgcactctcatccaaacagatttccttagatgacacggtgaccgtctccgaatatgcagcaagcatgggcggttcccaggtgtttttagaaccgggtgaaacccagacagtcgaaacgatgatcaaatgtatcagtgttgcgagcgccaatgacgcctgtgttgccatggcagaacatgttgccggttctgaatcagaatttgtccgcatgatgaatgaacgcgcaaaaggactcggcatgaatgacaccaatttcgtcaactgctgtggtttagatgccgacggacatatgaccagcgccaatgacattgcactgatgtcgcgcgaactgatcacaaaatacccgaaaatccatgattactgcacgatctggatggaaaatatcacccacactaccgcaaaaggttcctcggagttcggtctgacgaacaccaataagctgatcaaacattaccagtatgccaccggcttaaaaaccggatttaccaacactgccatgtactgtatttccgcaaccgccaaaaaagatgatatggaactgatcgccgtcatcatgggggctcctgatatcaagtcacgctctgcggatgccacgactcttttgaattatgggtttgggaaatgcaggatttactgtgacagccacgaagataagttagacgatctcccggttaaaaaaggccttgcggattctgtaggcatcatttaccaaagaccttttcaatacatgacaacagacggaagtgatcttaccggcattaccaaaagcatcgaactgccggaaaatgtgacagcaccagtaaaaaaaggaaacactgccgggaaggcggtctattctctaaatggaacgccgatcggcagtgtcaatattgtatatgcggatacagtcgatgctgcagattataaagattatttttgccgcaccctgttatattttgttccttaaaaatacagagtccggtgtatcactgatttgatgtcatgaaacattctgttattacatatcactgatctgatggtgcggaacatttgttctcatattataacaacggtgcaaacagacgcatcaggctctgaaccatacgtaccggaagtcttcgtctgcggcagaatgaaacatccatctcctccgactcttcaaatgtcctgaggcagtcttcctttacctgcatgactgccttagaccggtacataaatacaccacattcaaagtgtaaaaacagactccggtagtcaaggtttacactgccgaccgtcgcgatctcatcgtcacagacaaagcattttgcatggataaatcccggtgtatactgaaaaatcttcacaccattctttaaaagcggttcataataagactgtgttaaaagatatactgcctttttatccggcacacccggtgtcacgatccttacatccacaccgctctttgctgcatttgagagacagatcagcatttcgtgatcgatgatcagatatggtgtaaaaatatacacatagtttttcgcacggtttatgatattcagataaatattttctccgacgttttcattatcgagcggactgtcaccatacggctgtacaaagccatcggaggtaaattctttctccctgtaaacagacggcaggaatctgctgtaatcttctgtggaacggttgatataattccacatttccagaaacattgccgtaagactccagactgcctctccctcaatccgcactccggtatctttccagtatccaaaccttttgactttattgatatattcatcggcaagattgataccgcctgtaaatccaatatacccatccaccacaaaaattttacggtgatcgcggttgttcatcaccacagagatcagtggtttaaacggattgaatgtcacacagggaatccctctctcctgcagctttttataatatccaaaagaaatagaattgatgctgccgacatcatcatagataaagcgcacatccactccggcctttgccttttcctcaagaatatcaaggatcgtattgaacatatatccttcttcaatgataaaatactcgaggaatataaaatgttttgcaccgcgcagtgcctctaacatatccgggaacatttcttccccgcagctgtaatattttgtctgcgtgttctgatataatggaaatcccgcccatttatcaatataagatgactgcagatatgctgaccggctttctttttctaagcctttctccactgcgctatctctctgaaacaatgcttccacctgacggttgacagcatccattctctctcttgtatgtttggtcagaccggatcttccaaataagaaatataccataagtccaaaaatcggcgacaataagatcaaaaacgtccacgagagtttattcgccggatttgtccatttattgacgattacaagcacaacaatgattgctatcacacgcacaagcaaattgacatacgtaaacttgtaactgagctgccacaatacgacacacagccataacacctgtaaaatgattgccatggcaaccacaaaaaatcttccaaatatgagatgtaatattttcttcatacaaatctccattctccctgcacgcttttcaatgaaagcaacgttttcatctgcatcacaagtttgtgccacagtacaaacatgtgcttattgtaataattttcctctcaaaagtcaacgcacgagatgatccacatgtatcatcccccatccgatcctgccaagctgcgcacttctcggatatgctctctcataaaggcgcagcttcatttctgccggagtaaatgatggatacttctcaaatgcaagggcaagcgcccctgagacaaccggtgctgccatggaagttccgctttttacctgatatccgcttttatccttgctgcagcttgtaataccggttccgggtgcgaggatttccggctttacgatgcagcatgcagtcggccccctgccgctgtatccggtttttaaaacttttctcccacggtcataggtatcatcatcactgcttccgaccgtcagtacttttcttgaaatacccggaatcgtcaccgtattttcttttggtccgttatttcctgcagcggcaacgaccatgatccctgcatcccacaattcatcgatcgcatataaaagctttctctgctcctccacacctgcgcccggtaacattcctaccgatatatttaatatcttaatatgataacgttccctgttctctttgacccacatcactgcatcaagtacttttttcgtatttccatttccattttcatctaaaacctttaacatgataatcctgcattttggtgcaactccactgtatatccgaaccttatgtgcagtatctttcagatactgctcagacatttttccgtttcccgcaataatccccgaaacatgggtgccgtgaccattatcatcatacatttcctttcttccattacaaaaatcatgaaaatatatgattctgtcctcaaaatccggatgtgcaacaataccggtatccatcactgcaacggtaacattctgtccgctaagtcctgatctgtatgcataatccgtgtgaatcatcttcttcacccgatccatagtctctcccattctgtcaaagaacttccatattattatatgaagaaatttattttctgctaaaaatgataaaaaaatgttaaatttttctgaatattcagaagaatgtttgacacttggcatgattttccttataataaataatagttaattagtgaactattttggttcgctttaaaatcaaaaaagaaagtagtgtgatgccatcttgaacaaaaaactcaaagaaaaatttgacgaatccgtaaatgcagtcctgccgatcacggtgatcgtgctcctgctttccatttttgttgttcccatggaaaccggaacgatcgccctgttcttagtcggtgcatttatgctgatcatcggcatggcttttttccagctcggtgcagaaactgccatgacacctctcggcgaaggcgttggttcttccattatgaaaacaagaaagcttcctgttttaatcggcgtatgctttctgatgggtattatcataaccctcgcagaacccgatcttcaggttcttgcaaatcaggttccttctattccgaacaataccctgatctttacggttgcacttggtgtcggcgtattcttagtgatcgccgtactccgtattctctttcggatcagtcttccagttcttttgtgcattttttatattgcactgttttttctttctttcgcggctcctgctgattttattgcagtcgcatttgactccggcggcgtgacgacaggtcccatgacagttccctttattatggcgatcggtgttggtctctccgcaaccagaaacgataaaaacggttcgagtgacagttttggtctgatttctttttgcagtgtaggtcctgttttaatggtccttctgcttggcattttttatcatccaactggtgccgcatacaatgagacaacaatcccggacgtaatcacgatgcaggacgtgatccgcgaatttgtacatatgataccggattatgcaaaagaggttctgctgtccatccttccggtaattttcgtatttctgatcttccagcttatttccagacgttatcacaagccacaggtgatcaaaatgatcatcggtttactctacacgatcatcggtctgatccttttcttaaccggtgtaaacgtcggatttgctcctgttggaagtcttcttggaagcagtcttgccggccagccgtggaaatggattttaatcccgatcggtgccttgatcggttactatatcgtaaaagcagagcctgcggtccaggtattaaaccgtcaggttgaggacgtcacaaacggctctatttccagagataccatgaatttaagcctgtcgatcggtgtatctgcctccgttgcacttgcattgcttcgtgttcttaccggtttaaacatttactggcttttaatcccgggatacctgattgcactgattctgacaagatttgtaccaaaagtatttgtcggcattgccttcgactccggcggtgttgcgagtggtcctatgacttccacttttctgctcccgcttgccatgggtgcatgtaccgcgatcggaggaaatgtagtcacagatgctttcggagttgttgcgatggttgccatggcaccacttattgcagttcaggtcatgggggtctcctataatatgaaattaaagaaagcaagtacccctgccgccgccatcattggcattgacgacaatgaaattctggattttgaggaggatttttaacgatgcaggaacagaaaaaacgagaagcttaccgctgccttgtaattatcacagactcccatatcagagagcaattatgcgaatttttagcagattcccatataccggtctactatcagatgcatgggatcggcacagccagttcagaatggttagaattatgcggtcttggaagtatccagaaaagtatcacactctgttttattccaaacggacgcaaaaaaattctgctcgctgaaatgaatcaggcattgagccttcataaaaaaggaaccggtattgccgtcagtattcccatgaacggtatgcagggatttctatataaacttttaaacgagcacaccgcagaatcagacggcgaagaagttgaaaaggaagtgaaaaagatgagtgaaccaattacacatgctatgatacttgtaacaatcaatcagggatacagtgacgctgtcatgaacaccgcgcgcgctgccggtgcaaccggaggcacgatcttaaaaggtctgcgctgcagtcccggaaaatcggctgtcatcttcggcatcacgatccaggaagaacaggaaatcgtcgcaatcgttgtaccaaaagataaaaaaacagagatcatgcaggcgatcagctctgctcatggaatggactctcctgcccatggtgttgccttttccctgccagtggacggaattatgggattgtaatgccgatgaggccattctattgtcaggtattacaaaaaagaactgcacgttaataactatcattaacatacagttcttttttcaaatccatatatcttgtatatagattatttataatttttaaactatttgttttttcttatgcctctgccggaacatccttcatagagaagctgatgcgtcccatcttgtcttttccaaggcagacaacttttactttatctcctaatgtcaggacatcctccacacgattgatacgctctttggaaatcttggaaatatgaaccattccctctttacctggagcaaattcaacaaatgcgccaaattctttgatgcttacaacagtaccagtaaagatctgtccctctgcaaagtcagtggtgataatcttgatcatttcgattgctttgttcatcatctctgcgtctgtgccacatacagatacagcaccgtcatcggtaatgtcgatcttaacgcctgtgcggtcaatgatctcgttgatcgtctttcctctctgtccgactacatcaccgatcttgtccggattgatctggatctgaacgatcttcggtgcgaatgtgctgacttcttttctcggctcctcgattgcttttgacataacctcatccatgatgtagattcttgcctctctcgcacgtccgattgcttcctcaacgatcggtcttgtaagaccatggatcttgatatccatctggattgctgtgatacctttgtgtgtaccggttaccttaaagtccatatctccgaagaaatcctcaagaccctggatatccgtaagaacaaggtaatcatcatctgtgtcaccggtaacaagaccacaggaaatacctgcaaccattgcttttaacggaacacctgctgccattaaagacatacaggatgcacaggtggaagccatggaagtagatccatttgactcaaatgtctcggatacggcacggatcgcatatgggaactcctcctcagaaggaagtactgccataagtgctttctcagccagtgcaccgtgaccgatctcacggcgtcccggtccacgggaaacttttgtctcacctacagaatatgcagggaagttgtactgatggatatatctctttgttgtgatgttctcatctaatccgtcgatcttctgtacctcagaaagcggagctaatgtgacaacatcacagatctgtgtctgtccacgggtaaacattgcagaaccatgcactctaggaatcaggtcaacctcagctgcaagcggacggatctggttgattgcacggccatccggacgtttgtggtcttttaagatcatcttgcggacagtctttttctgatactggtaaacagcctcgccaagcactgccaaccactcttcgttatctgcgaatgcctcagcaagtttatctgtgatctcacggatgttctcttcacgtttctgtttctcatcggtaaatacagcttcttccatctgctccggtgttacgatctctttgattgcagcaaacatctcttccgggattgcacagcttgtatactcatgttttggcttaccaacctcttctacgatatggttgatgaaagcgatgattgtctggttcacatcatgacatttatagattgcctcgatcatcttctcttccggaatctcatttgcaccagcttcgatcatgatgactttctcagcggtagatgcaacggtaagctgtaaatcaccggtatcccatactttctgggaaggattgataataaactcgccatctaccatacccatctgtgtcatggcacaaggacctgcaaacgggatatcagaaatggtaactgcaagtgcggaaccgatcattgcaacaacttccggacggcactccgggtcaacagacataaccatgttgttgatggtaacgtcgttacggtaatccttcgggaataacggacgcatcgggcggtcgataacacgggaagtaaggattgcattctcggatgccttaccttctctcttgttaaatccaccagggatttttccgactgcatacattttctcttcgtactcaacgctgagcgggaagaaatcgactccgtctctcggcttgtccgatgcggtagcagtagataaaactgttgtctcaccgtattttaataatgcggctccgtttgcctgggcacatactctgccgatatctacggtcagtgttctgcctgcaagttccattgaaaaacttttatacatgcgttttctccttttctctgtggagacagaagcaccgaaactactgaaaaatccacgacctctcatacatttttcagtggtctcggaaatatacttctgcctttggcaaagaacctgttttcacaggattctttcttattttaactgaaaatcgagtggagtaagtctccactcgataaaaccgtatgaaaacagattccatacggtatccatacatgccagcctccatgcggaagcggctctgtatggagaagatcttattttctaagacctaagcgctcaattaaggaacgatatctttcgatatcaactttctttaagtatgccagtaaaccacgtctctgaccaaccatctttaaaagaccacgtcttgaatgatagtcgtttttgttctcagcaagatgagcatttaactcctcgatacgtgctgttaagatagcgatctgaacttccggtgaacctgtatctcccggtgttctgccatactctgcgataattgcctgtttcttttcctttgcgatcatgttatgatcctccttttcttattaaacgcccgttccggctgtgccgggatatgatactcagtaaaaggtcggagtgtccatctaccgaatatgggctaaactcatactccgctattatagcatgggttgtttctgttgtaaatgcctaaatttaattattgatcacacggactactttgaccggtgttctatagtatgctcctgagatcttgataccggacttcggtgaacttgcatgtaccacacggccgcctccaatataaatagccacatgattgatactgcttccgttgccgtagaagaaaagatctcccggctgtgcatccgatgcggaaatctttgtaccgcagtttgcctgtgctcttgaagaatgtggaagtgaaatgccatagttggcaaatacgctcatgacaaatccggaacagtccgcccctcttgtcagactggttccaccccatacatacgggtttccgacaaactgtgttgcataggaaacaagggatacacggacatccgatataccctgtccataacggacttctgtcatagtctgtgccttcggaagttcggttgcaatgctgacatagtctgaagagacatatccctcatcactgtcgacattgatctttacccagccgtcaaggacttcaagaacctcaagttcctcaccctccggcatcatggtgatgacatggctgtctgtgtttgcctcgtcacggacataaagcgtggtcgtcgttacggttgcaactgtctgctttacttcctgtgcctttgcgatcgctgcttcaccggtcataagatattctgattttacatatccttttacttttccggactcgatctgtgtccagtcaccatctgttccgataatctcacatcctgcattgtttggcagctttccaacaatctctgcctctgttcccggaacttcacggacattgatattgccatctgcctgtgcgattcccagatttgtgtatccaaatgcactggctgcctctgcaagcgcctgtgcctgtttttcttcctctgtttgtgtctcatcttcctgaccggatgcagtcatatcacggtcggattctgaaacactgaccatatctgctgcggtaacagaaaggtaatccgacatcacatcagtaacaccggatgcaagatccgtaccctgttttgtataattttccatctgttctgccaatgtggaagacacccccgcagacacttcatgtatctgggaatctgtgctctctgccattacttcctgtgtgtctttcacacccggctttccatcaatataagctgctgaaaatacaagagaaccggctgcaagaagtccggctgccttaacccattttgctttcatatccgtacctttccaaagaatcctgaatacttcgtttatcaataccgctcaagtatagcagtcattttttacaatgtcaacatatttatgtaacatttccgtaatatttaggattcatttttctcgaaccatgccctcgcatatgcaatattattctgcatttcctcttttaaagcctcgatggatgaaaatttccgttcctcccggattcttgtcaagaactcgaccgtcactactttgccgtaaagatccccggcaaaatccagaagatgtgtctcaacaccgaccggattttttccttcaatcgtcggtttcaccccaacgtttgtaacgccacggcagctccggtcgccaagccgcacttctgtcacatagacaccactctccggaagcagtttttcctccggcggaatctggttgatcgtcgggattccaagtttcgtgctgcctaaatgtcttccgtgaaggatctcccctgtcacaaaatagtgataccctaacagatgatttgccttctcaatattgccctttgcaatctcttcccggacaaatgtgctgctgatatctctcttatcttcctgcattttatcgatcacaagcacttcatagccatacttgtccgataaatctttcaacatgtgataatcgcccctgcgattgtgcccaaagtgaaaatcagaaccaaccacaaaacactttacatgaagctgatgcacgatcttggcaatgaaatcttccggttccatgcacatgatctcttttgtaaacggacactcgaccagatagtcgatcccaatctgctcaaagatatgcattttttcttcattggttgttaaaactttcgcctcaacctgttccacacttttccgtggtggaatattaaatgtgaatatgaccgctgcaagtcccgcttcctttttggatgccagatgttccatcaggagttcatggcctctgtgtatcccgtcaaattttccaagtgaaagtacggttggctcttcaatataaaattcggttgtgtttttcagatatttcatgcttccataaacaattttaccggtttataatccccgtgtatctctgagtactcatatatcccgataaaacgcccttcttcatcataaatacggaccttctgctgttcccagtctttctgataagaaacaaacatgtcttttttcatccggtttccattatataacagtttgttccattctttgcagatcaccgcttttttatactgtaaaaatacggaatcaaccgcataaataaaatcaaacatctctgcgttccactgttctgacggtgtctgtcctgccgctttttgtacacgttcttcgatctcggagaggcgaagcgcatcctgtacacaaaattcagatacctttgtgcgcagcaaggattccatacatgctccacaggaaagtttctcaccgatatcctgacataatgtacggatataagttccctttgagcagcgcacacgcatacagacccggggcagttccattttaataatctcaatggaatagatctgaaccggtcttgcctgacgttccaccgtcacaccggcccttgcgagatcgcacagtttctttccgttcacttttaatgcagaatacatcggcggaacctgcatgtattcccctgtaaaagaaaggactgcctcttttacctgctcttccgttacttctaccggatgttcctctaaaacagttcccgtggtatcctgcgtgtctgtcacctttccaagcagcatcaccgcaacgtattctttgtttttgtccgtcaaaaggtcgcagacttttgtcgctttaccaagacacacaggaagcactccctccgcatccggatcgagtgtccctgtgtgtccgattttctttgtttttaaaatacctcttagttttgcgaccacatcaaaggatgtatatcctttttctttgtatacattgataattccgttaatcataaattttcccgtctcatgtacagccgtcattttctgcaatctgaaaatttcaggctgcctgtatcgttaatctgtgatctgttctctgatatcttcaataatttcattcagccgtttttctggatctcccgccacggaaaaacctgctgccctgacatgtccgccaccgccatattttgctgcgatctttgcaacatccacataacttgcagaacgggtgctgactttataattttcttcatctgtctggtataaaaagactgctgcttccacgtcctttgtcacgcgaagctggctgacgatcccgtctaaatgtttcggaagaacattgtattctctcatttcctctgcagttatgatactcgagatgcattttccatccagatgcagcttactttttaccagcgcaagtcccatgatacggttctgctcataggtttttgtaaaaaacgtctgatccacgatcttcgggaaatcaatgcccattcccatcagaacacctgctgcctccatcgttttttccgatgtgcaggaatactggaacacaccggtatcatggatgattccggtataaatgcattctgcgatctctttggtcagacgttctctcgggatcagttcaaataccagttccgacgcagaactcgcctgcgggaaaatatagttttcatccgcaaaactctggttactgatatgatgatcgatacacgctgttttttttgcatgctcaaaatattttgccgcgtctccaagtctgcccagatccccgcagtcctgtgcgataaacagatcaaactctttatctgcagtgcagtcgcttatgatcttatccgcatttttcataaatttgaaaatattgggtatcggctgcagatacaggctgacttcgatctgcgggtaatatgtcgtaatatagttataggttgcaaggcaggagcctacgcagtccccatccggtctgatatgacctgcaatggcagctgtttttactcccgcgaaaagttcatcgagacttttcatgttctcctccatccccaaatatacgcttttcgtttgtcttattcctctgcgtcatcttcgcttttgatatcttttgtgacctcgtcgatcattttagacatctttacaccatattcaatcgactggtctaacacgaaacggatctccggtgtattgcgcagatttactgttttcgcaagtttgctgcggataaatccctccgcgctctttaaccctgcaagtgtttttgcctgggattcttcatctcctaaaacactgatatatgctttacatgtttttaaatccggtgcaacctccactgccacaacgcttgtcagcgggttgatccgcgggtctttgatctccccgcggatgatattggaaagttcgcgctgcacctctccattgatcctggtatttttaatactgttttttctcattttataacctcttagcgcggtacctcaaccattgtatacgcttctacgatatctaattcctggaaatcaccgaaaccttcaaatacaagaccgcactcaaatcctgcttttacttctttgacatcatctttaaatctctttaaggaagctaaatcaccctcaaagatctgttcgccctcgcgggaaatacgaactttacatcctctctggaacataccgtcaagcacataagaacctgcgatattgccgacgccggaagccttgaagatctgacggatctctgcatggcctaatactttctcttcgtataccgggtctaacattcccttcatggctgcctctacatcctcaattgcattgtagatgactttgtagagacggatatctacgttttctttatcagcagtaagttttgcagtcggatccggacggacgttaaatccgatgatgatcgcatttgatgcagatgcaaggctgacatcagactcgttgatcgcaccaacaccaccatggatgacttttacaacaacttcttcgttcgacagttttacaagactctgttttactgcctccacggaaccctgtacatcggcttttacgatgatatcgagttctttgacatttccggactggatctgtgaaaacagatcgtctaaggacatcttcgctttcgtatcttcgatcagacggttcttgccctcggaaatataggtctcagcaaatgctctcgcctctttttctgtatccatggcaacgaatgtctcgcccgcttccggtacagaggataaacctaagatctctaccggcatggaaggaccagcttctttgacacgtcttccctgatcatcgatcattgcacggactttaccatagcagcttccgcatgctaccggctggccaacttttaaagtacctttctgtaccaaaacagtggcaacggcaccgcggcccttatcaagctgtgcctcaatgacaagacctcttgcattacgtttcggatttgcttttaactcaagtacttctgctgttaaaaggatcatctcaagcaggttgtcaataccctcttttgtatgtgcggataccggacagaagatcgtgcttccaccccagtcttccgggataagttcatactcggataactcctgttttacacgctcgatatttgcactcggcttatcgatcttgttgatcgcaacgatgatctcaacacctgctgcttttgcatggttgattgcctctacggtctgtggcattacaccatcgtctgctgcaacgactaagatcgcaatatcggtggaatttgcaccacgcatacgcattgcagtaaatgcctcatgtcccggtgtatctaagaatgtgatattctgaccattgatggataccacggatgcaccgatgtgctgtgtaataccgcctgcctctctgtctgtcacacgggtagaacggattgcatccagcaaggatgttttaccatggtcaacgtggcccataacacagacaaccggtggacgtgctactaaagtatcttccggatcttcttcctcttttaagagttcggcgatcacatcgactttttcttccggctcacagatgcagttaaactctaatgcgatttcttctgcctgctcgtaatctacttcctggtttaccgtaaccatcgttccttttaagaacagtttttttacgataacggatggctgtactttcatcttgtcagctaactctctgatcgtaagtttctccggtaataccagtgtgcggatcacatcctcttccggctgctgttttggctgctgctgaggtttcttcttgccaccgttcttctcaagattgataaagcgctcctgtttctttccgccaagtgcatcgtaatcgttgcgctgtcttgcgtttttgtttctgtccttatcgcgctctctggattcttttcctcttaactcctccggtgctgctgcagctgcctctttattgaagcggtcgatctcacgatcaagtctgccgccaccattatttccaccacggaagccattgtttctgttgttatttctgtcgccctgaccctgtcccggtctgccattgttctggtatggacgctgtccatcgtttcttccgtttctgtcaccgtacgggcgctgtggtctgtcaccattgtttctctggtttcttccatctccctgcggacggcgctgaccattattgttacggtcgcgtctgtcattattattcccctgacggcggtcattattctgcggacggtactccggattctgtgcatagacattttctcttggagtctgtacctgtactttttcaaccgttttcttcggctcttccgctgccggttttgcctctctctgtgccttcagctctgctgcttttgccgctgcaagatgctctgcctcttccgctgcttttgctgcctccgggttaattgcgcgttcaaatgcttttcttacatcataaccggatgtcggtcttgcctgcgcattgccgcggtttggattctgtccctgtggacggcggtcgccattcccctggcgtctgtcaccatttccaggacgtctgttgttattgccgccgcggccgccgccctgtttgctgtactgtgcattgaacacagcagtaatgcttgattttttcttcgggcgctgctctgcgttctcagtttttgtaccctcagccggtttattctgctcgtttgcctgtggcttctgtgcaggtttattttccggtgccgctgtcttgttctctgcaggtttgctctctgacacattttctttattctgtgcctttgcagtattctccgctgctgcagactttccaaatttctttctcacgatatcctgtgccggatcatcgatattgctggaagctgctttcactgcatattccgtcgtatttaatgtttctataatctgtttactctctattcctaattcttttgcaaggtcatatactctcatttttgccatttatcttaattcctcccattattcagttgtgattgctgtttcagtctctcttcgatcgagtgcgacagtccctcgtttgtgactgcaagcgatgcacgaaattcttttccgatgaaatgcccgagcatttctttgtccgaatattcatacattggcacctgataaaaatctgtcatatttcgaaacattttcttcgtattgtctgacgcatcctgtgcaacgatgacaagatatgccctgccctcttttaccgccttttccgtagaaaattctccactcgccacactgccggcttttgcggcaattcctagcatagataacactctatctggtttcaagctgttccatctcctttgtcagcgtttcatatacatctttcgggatcggcattttaaatgatcgttctaaccctttattttttatcgccattgcaagacattcacggtttgggcagatataagcacctcttccgttctttcttccggttgcatctaaaatgatctccgtttccccttcttccgtcggcgctgttttgatcacacggatcatttctcttttggctttcatctcatgacagccgacacactgcctcatcggaatctttttatttgacattcttcttaatacctcttattctctgtcctcaccatcagcttcggcattgttttcttctgctccgtcagtctcatagctgtcttcctcatagccttcctctgccggtgcactgccgtcctcgtactcctcataggacccgccgtcctcatcgtaatactcatcttcctcgtaatcattctcgtaatctaagaaatcgccggactctctcgcctgtgtctcgctcttgatatcgatcttgaatcctgtcagacgtgctgcaagtcttgcattctgtccttcttttccgatggcaagagaaagctggtaatccggaacaaccacttttgcagatttttcttctgcatccgcaataacagaaataacttttgccggacttaatgcattttcgatcatcattgccggattctcattccaggtgatgatatcaatcttctcaccacgcagttcaccaacgattgcattgactctggcaccattcataccaacacatgcaccaaccggatcgacatctggatcgtttgaccatactgcgatctttgttctgcttcctgcttcacgcgcgatcgccttgatctctacgatgccctcgcggacctcagccacctcagactcaaacaggcgttttacaagttccggatgtgttctggaaactaacactttcggtcctttagaagtagccttaacctctaagatatataccttgatacgctctgtcggctggaacacttcgccttttacctgttcattctctgttaagatcgcatcgacccttcctaagttaatgctgacatttcttcccacataacgctgtaccacgccggtcacaacatctttttccatgctgtaatactgatcgtataaaactttacgctcttcttcacggattttctgtaagatcacgttctttgcattctgtgttgcaatacgtccgaattccttagactgtacctcgatgttgacaacgtctccgatctcatatttggaattgatcatctttgcattgaccagactgatctgctctaccggatcttctaccgtttcaacaactgtcttttcctgaaatacatgaaactcacaggtttccggatcaatcgatacttttacgttatcggatgaaccaaaatggttcttgcacgctgttacaagagaattttcaatcgcttcaagcagtgtatccttgctgatgtttttctcctgttctaatatatttaacgcttctaacaactcattattactcattattaaatcctccttgttttgcggagcaaaatgcctgctatgctgtttttgcatagcatgtgcccttgcagggagcaatgcccagcacactgggcaggattttcctcctttagttcatctttaaaagtcaaatgccagacggatcagtgcgatatcgctcttttcaaacgtcatttccgttccgtcctctgtttttatcgtcacggtattttcatcatatgcagacaaaataccataaaattccttttcacggttgattgcacgatatgttcgtatctctacttcttttcccatgctgcggatataatctttttcttttttcagcggtctgccaagtcccggagagctgacctcaaaaacataggagtcctcaacgaaatcttctctgtctaaaatctcgttcatctcccgcgccactgcctcacagtcgtttacggtaatgccgccttccttgtcgatataggctcttaagtaccaggtaccgccttcctttacatactccacatcgaccagctcaaaattcatgcggtctaaaatcggagtaatcagttcttcggtgcgcgtttcgtatgtttcacgttttgacatgtgtacaccttctttcttccatattcagttttccttctgcatgcatttctgttgcagaaatacatggctcctaaacgtgaattgagagagggctttcgtcctctctcaatcaagtcatcgtgttatcatttattaatgtaacactttcctctttaaaatgcaagccttttacattttttctgacaaacaataaaatcatacaacataaaaaattgccaatataccatctggcatactgacaacttccgggttgggctgtttatctctttcgaaataacagtgagtagctcgtaggggaatcgaacccctgtttccgccgtgagagggcggcgtcttaaccgcttgaccaacgggccacaaatatttgatttatctctgttataaaacagaatagctcgtaggggaatcgaacccctgtttccgccgtgagagggcggcgtcttaaccgcttgaccaacgggccataagtatttgttcatctctgttataaaaacagagtagctcgtaggggaatcgaacccctgtttccgccgtgagagggcggcgtcttaaccgcttgaccaacgagccgaactgatacttattatagcatgtttttttttatttgcaagtatttttttgaagtttttttatttttttaaaaatatgaacaatttacacaatttcattctgcttttcccaccattttcatggcatttttacctctttttcatacatcagatcctctattacttcacgcaccgtcgaaatccgatctatttttccaacattcgaaccgcaaaatacaagtccgttttcaacgtctccatgcacagcacggatcaacgcctgtgtgatgcagtacggaatctgcgccggtttacagtttttaatgcagtgataacagcgttccacgctctccggcgcccgttctgtcttttggataaaagcattgtttaacgcacgccccggcatgccgaccggacttttgatgatttttacatcagtttcttttgcattcacatatgcttttttatatcctgaggaagcatcacactcttttgtcgcaacaaatcttgtcgctgcctgaactccgtctgctccgagtgcttcgatccgctttgcatcggatgcatcccagatcccgcctgctgcaaaaacaggtatctgctttccatacttctcctcgtactttttcttttcctccatgatccccgtaagctcttcctcaaaacggatctttgaaatatcatctaactgctccctcgaaaatccaagatgtccgcccgcctccggcccctctgtgacaataaagtctgctgtcctgccgtattttttatcccaggtttttaaaagcagcgccgccgcgcgccttgacgatacgatcggtgcaatctttgcttttcctgcttctaccagctccggcagatccactggaagcccggctccgcagattaccgcatccgccccggcacgcaccgcctctttaacatgctccctgtattgctgtaatgccaccatgacgttgactgctatcattccttttccagatgccagttcttttgcacgcacgatatgctttcggatactgcgcagattgcacgcttcttcatttcccacaaaatccggttcctcaaatccgatctgtgccgtggagatcacgcccatgccgccctccgatgcaaccgcgccagccaggccgcttaaactcacaccaactcccatgccgccctggatcagcggcagactcagattccatccttcaaaacgattcattgaaaaaattttcttcattgtctttccctctattgtatatagtttttattactatatataatggtatcattcaatatataatatgtcaacaataaccatattattatttgtaaagaaaaacgactgtaaattttttacgtttacagtcgtttttcatgtttttatcatttataaattatttattcctgcgcaaagacatcgacctcttctatcgtaagtcctacaccgtctgcaatctcttcctttgacaactttccccgtttcagctatgcagatcaatcgtcatatccgttcggattgttcttctgccatctccaggaatcttcgcacatctctttgataccatactgtgccttccagccaagctcacgctctgccttcgaaggatcacagtaacaggttgcaatatcacctgcacgtctcggtttgatggaataaggaatcttcacgccggttgcagcttcgaagtttttgacaatgtcaagcacactgtaaccatgacctgttccaaggttatagattgcaagtccgcatttctcatcgatcttctttaatgcttttacatgaccgagcgcaaggtcaactacatgaatgtaatctctgacacctgttccgtccggcgtgtcataatcgtcaccaaatacgccaagttcttttaatttgccgactgccacctgtgtaatgtatggcatcaggttgttcgggatgccgttcggattctctcccatggttccactcttatgagcaccgatcgggttaaagtaacggagcaagatcacgttccactccggatctgctttctggatatccatcagcacctgctctaacatggattttgtccatccataaggattggtgcactgacccttcgggcagttctctgtgatcgggatttctgccggatcaccgtatacggttgctgaagatgagaaaataatgttcttgcagttatgctgacgcattacatccaccagagtcaatgttcctgaaatattgttgttgtaatattcccaaggtttctgcacagactcaccaacagcctttaatcctgcgaaatggatacagctatcaattttttctttttcaaaaatctcatttaaaattgtgcggtctaagatatcgcctttataaaaagtcacttcttttcctgtgattgcttttacacgctctaatgatttttcagatgcgtttaccagattgtcaagtacaacaacctcataacccgcatttaacagttctacgcatgtgtgacttccaatgaatccggcaccgccggtaactaaaattgccatagttttttccacctttccataacaaatctttttgttttccttcaacgttatgggtacatcttaccccattctttggaaaatgtatagcaaaaaatgtgtatattatatgtaaaaatgttgcatgttgactgagtggccggtataattatttagtgcagagccgtggggttgtggccgtcaggccgtgtgaagccgctggcagtggattaccagagaataatggaggattgccatgtacgaaaaatataaaaattcttacaaagtaacagagaaagaactggtttcactttccgtctataacgtgggatttcagagatgtgactcgctttatcagtggggaccgggaatccgggatcattatctgatccattatattatttcggggaaaggtttttacaagattggaaaaagaacttatgaattgcaggctggggattcttttttggtgtatccaaatacagaggttgtctattacgctgcagagactgacccgtgggagtatgcatgggtgggttttacgggcagtgacgcttccatgatcttaaaggcaacggatttttcgccggaaaaaccgatcatacgggagacaccgcacggaagtgatatccaccgccagatactccatatttacgatgccagaggaaatgaatttgagcatgccgtggaaatgaccggacggctctatacgatgcttgccatgtttttacacggcgcttcccatacgacggagcaaaattccgccaacagttatgtgcagaaaggcatcgagtatatctcttccaattattcttatgcaattactgtggaggatatcgcagactatgtcggcgtcagccgcagccacctgttccgttcttttgaatcggtgcttggtcagtcgccaaaggaatatctgactgattttcgcatgaaacaggcgtgttatctgttagaacattccagcctgtccatcaccgcgattgcaaattcactgggttttgacaacagcttatatttttccaaaacgtttcacaaacaaaaacaaatgtccccaaaagaataccggacacattcccgtacctcctaaccataaaactcactgccgttccagtatgcttttgcctccccggcaagcactgccctgcaaaaatctttttcatcggagagcttccggtcaaacagcatgccgccaccgatcattctggtggtatgctgatccgagccagccgtaatcggaagtccatgttctttcgcataggcgatcgctttttcattatacaggatatttttatgcgacgtgctcgcaggactctcatgcgtggcattgattccctccactgcatctacacagtccgggaaaaggcggatttccggaatataatcctcctcacgaaacggatgcgcgtggctgacgataccaccaccggcatgtaccagttcatactgttctttcacatctgcgtctttgatctcgggatgttcaaacagccattctttgtttaagccataaattaaaaattctgttccgtgatatcctgactcccatccgaaaaacacctgcagtccgatcttatcgccttcttctttcgcatgttcatagcccttacagaactgttctacccagtctttccatggaaggctccggtccgccgccgtatttccataaaagaaatgatctgttacgacgatgccggcatatcccgctttctgatatgctctcgccatctctgctcctgtattctgtccacatgcgcttccctctgatgtgtgcacatgggtgtcatataaatatccgtttatttgcatgataaaccaccaatttacctttcataagcgaaaaaagaacttaccccggggttgtcccaccggaataagttctccctcatcttgtcctataattaagcaactgctttctttgcgatctcagctaatgctgcaaatcctgctgcatcgtttacagccatctctgctaacattttgcggttgatgtcaacaccagctacttttaagccatgcatcatctggctgtaagagattccgttcattcttgctgctgcattgatacgagcgatccataactgacggaactgtctctttctctcttttcttcctgcgtaagaacttgttaaggctctcataacagactgttttgcaacacggtactgtttagaacgagctcctctgtaaccttttgctaattttaatgttctattatgtctttttttagcgcctaaaccgcctttaactcttgccatgatctattcctccttaacaactttcttacatgtatggtaaaatcttcttcatattcttaacgtttgtagcatctacgatagccggttttctaagatttctcttattctttgttgttttctttgttaagatatgtctcttgtaagctttatttctctttaattttcctgttcctgttactttgaaacgttttgcagctgctctgcttgttttcatttttggcatgatatattcctccttaaaattatgattttttttctgccaacaccatgctgatgcttctgccttcaacctttggtgctttttccactactgcaacctctgcaagactctcagcaaaatcatccagaatgtgtttgctggcattcatatgtgccatctcacgtccgcggaatcttaaagtaatctttactttatcacctttgctcaagaatttttttgcagcattcattttggtgttcaaatcatttgaatcaatattcggtgacagacgaatctcttttaactcgaccactttctgtttttttctggcttctttctcttttctagccatctcataacgatatttaccgtaatcgataatcttacataccggcggctttgcggtcggagcaatcttgaccaaatcaagctctgcttcctcagccagcttcattgcttctcttgctgacataatgccaagctgttctccgttttctccgatcagacgaacttctctgtctctgatctgttcattaatcattaactcgctaatggtattgcacctccaaaatattattctttacttgcatcaaaaaaagtggataggcagactatccacttttaatactcaatactcgcaaggtgcggtacttcaaacaacaggaatattcccgatgccttgaatataaaaccatgagtcacacgaatgctggtgctccggtgagagtggatactctactttgttttcaacaactattatactataccacttcaaaaaatctctgtcaagtactttttaaagtttaagaatgtcccctgctaagacattcttaaactttctatcctgatattaattattcctgtggaagaatgtatttactgatcagttcatctaaggatactgcctgagcagaaagctcctcactggtagcagaggactcctgtgcggttgcggagtttgcctgaacaacctccgaaatctggttgacaccctgttctgcctgatccatggcagttgcctgatctctggatacctggctgatatttttggaagactctgcaatcttgccgattccttctacaaccgtttcaatggatgctgcagctttgtctgccgccttgtttccttctgcgatctcctctaaggatccttcgatcagttctctggtatctactgcagattttgtactctgctctgctaactgacggatctggtcagcaacaaccgcgaatcctcttcctgcctctcctgctcttgctgcctcaatggaagcatttaaggaaagcaggtttgtctgggatgcgatatcctcaatctcagaaatgatgttctcgatatttttggatgtctcgttgatgcgtgtcattgcatctaccattgctgtcatctgcgcacggctgttgtccgcttcgtctgcatactgttttgcctgtacataggactcatgtgcctgatctgcagctttttcaatgttctctgtgatgcttgtgatcgtagcctgtaactcttctactgcacctgcctgctcagtagcaccctctgcaagactctgggatgcctctgcaaggtttgtagaacctgcagatacctggctggatgcatcttcaatagaacgtaatgtaacgatcatctgattcttcatatcacgcatggcaagaagtaatttttcaaattcaccctgatatacttccggacagtctgatttgatatcaaagttaccgcttgccatatcagcaagatgtttgccacagtcagcgataactatatttaatgtttctttcatctcatttgctgtctggattatgtcagccacctcatcatgcgtatctactatcgggaatggatctgtgaggttaccttttgcaaatgttgtaaaacggtcgcttaacgcaccaagaggtactgcgattccttttgcaatggaacttcccattctcattgcctgtgcaaatgcaaatacaatacttgcaacaatcacaataaggaaaataatactaatggcagaaagtcttgccgcaagggagtctccttcgtttatgtttgcatccagcaagtccgctgtaaggctgtaaacctgctcatacaatggatctacggtatcgttcatcatttgctgggctttgatgctgtcttcattgtccgtggaagcgccgatctccatcgcttgggcttctgcatcccagtactgctgaacaagtgtgttcacctgctcatagagatctttctcagtgcctgtcacacaggtgttcgcaactatagcccagtaatcatcaaacttctgtttcttttcatcatgtatctgtttcatggttgcgatcatatcagtatcattgtaaccaatcacaccgcgcgctgctgatctcgcatctgcaaaaacgatcattgcctttccgatatcaccctgcgaaaaaccataattagtaagtgcatgtttatactgcgtagatataataagcatcataattgctccaataacacctgcaatggatgcaagcagtgtaacgactgtgaaacattttttcagccgttcctgaatttttagattcttatacataaccttttcctcctgtttgtgcgctttatttactatgtctgtcaggtattgtcatcgataagctgctttatcccctgctgctcggactgtggcatcagctttgaaacctcaaacatcacgatcagctgcttatcataggatgccacatcattaaagcagctctgattggcattcatgatcgtcggcatcggaatcacctgtttttcatttacatcaatgatctcacggacactctctacttcaagaccaatcttcatgccattcatacttgccacaataacattttttatatcctgttttggatatccgaaatagtcagcaagattacatatcggaacgatatcaccatgcagattcacgattccttcgatatgcgcaggtgcatttggaacacctaccacactcattcttgtttcaatcgactcgacatcatccactggtattccaaaccggacattattgagcataaacgtcagtaattgcattctctcaccttctttgctgtatttttgcctataaaaaaccatcttatggttattgtaccattttagtaaaatatgtaaactatttttttatactttttttaattttttgacaaatatatttcattcatgctacgataacaccatctgctgactgtttttacagtcacttattaataatatgaaaggacttacagactatggataatagaattgttgacctgcacgtacattccacagaatcagatggcacctttactcccactgaggtgatcgcagaagccaaaaaagctggtctttccgctatcgccctgactgaccatgataccgccacaggtataagaaaagctatgggcgccgcaaaggaagccggtatcgagctgatcccgggcattgagctttccactgcttacacgtttccgggaaaaaaacaggaaaaggaaatccacatcgtcggtctctacattaacccggatgacccggaactcttaaaaatgactgctgaattccgcgaatgccgggataaacgcaatgaaaaaatgatcgctgccctgcaggaagaaggatttccaattactatggaagcccttctggcagagaatacagacagtgtcattacgcgtgcaaacatcgcacgtttcctttatgaacatggatggatcaaatccgtttccgaagccttcgacaaatacatcggcgatggctgccgctgctatgtcggacgttttaaagtatctcccatggaagccgtttcccttatcaaaagaaccggagggattgccatccttgcacacccgctgctttatcatctgggtgtagaacagctgcagctgctgattgatgacttaaaagctgtgggacttgatggcatcgaggcaatctactctacctataccaccggggaagaacagcttgtcaaacgcattgcaaaagaaaacgacctgcttatcagcggcggttctgatttccatggtgaaaacaaacctgccataaagctcggaaccggacgtgggcatctttatattccatattctgtcctgaccgatatcaaagcacgcgccgggaagtaacaccatttcacggattgcaaaaaatgtctgtcctataaaataaatttctcgatcacctcggcaatggcgtcatgattattgtcatttactgtgacataatccgctgccgcctttgctttttcggtggcattcttcactgcgaccccgatacaggccgtctttatcatcggcacatcattatcctcatccccgactgcaaccgtcgcatccatcggcatattaaggatctttgtcagttctaaaataccggttgccttgctcgtatttttcggactgtactctaaatactgactgctggaaaaaaagctgttacattttcccttttcccagttcagatttttcttttgaaaacgttctaacttgtctctctgatctaatgagatcagcataaccttctgtggttcttcctctaaagcatccaggatatttggtgatatcttataagaaatacgcgcctgtttcacatagtaatccagttctttcgtatgctttgtggtaataagatccgtactgttatatgtctgcacatacaggcccgcacgttttgccttatcaaaaagttcctgcacaatctcaatcggcagcgaacgctttaacagtacacggtctgctgcgcagtcataaagtactgcgccattaaatgcgatcatatagcagcccggtgtgtttaaccccagttctcttgcaacttctcttgctgtttcaaccggtcttccggttgcaagtgctatgtaatgccccgcctctaacattctgtggatagcctcacggtttttttgcgtgatgcttttatcatcacacaataatgtggcatccagatccacacataaaattttgtgattcataaacctctccccttcttatcggtaaaatactgctattctgcaggttccgccggaataaatacccgttcccggtacacatgatcctgtttcggaactgctgcaaccgcttcctcacagaactgcatctgtgaattgactaaaacttttcctcttttatcaattttctcataatttccatttgatttcaagagatgagcctttgtattatcagataattcaacttcgagaatgtgttttgcagatttttttgcctcatcatccagaacagggaacaatatttcaacacggcggtccaagttacgcggcatccagtccgcacttcccatatacacctcgtctgccccgttattctcaaaccagaaaattctgctgtgctctaaaaaatttccgacaatcgagcgcacttctatattttcactcacacccttgatgccaacctttaagcaacagataccacgcacaatcagctgaatttttacccctgctgccgatgcctcataaagtgccgcaatgatccccgggtcacagagcgaattcattttcgcgacaatgcgtgccggctgtccgcatttcgcatgtgctgtttctctgccgatcagtttcataaatttattacgaagccagatcggtgccagggaaagttcattccaggaaagcggctcggaataaccggacagcatgttaaataccgctgtcgcatcttcgccgatcgcctcgttacaggtaaaaattccacagtcagtatataattttgccgtcgaatcgttatagtttccggttccaagatgaacatatctgcggataccgtcctcctccctgcggacaacaagcgcaatcttactgtgcgttttcagacccaccagtccatagataacatggcagcctgcctgctcaagtttttttgcccagacgatgttattctcctcatcaaaacgtgcttttaactccactaaaaccgatacctgtttaccattttctgccgcctgtgccaaagatgcaatgatcggcgaattgccgctgacacggtaaagtgtctgtttgattgcaagaacatccgggtctgatgccgcctgacggataaaatcaacgaccggatcaaaggtctgataaggatgatgtaagaagatatcgcccttccggatcaattcaaagatattttctcctggttcgatctttggatttttctgcggcgtatacggtttatagcgcagatgatcacagccgggaagtccatacattttcatcagaaatgtcagatcgatcggcccctggatacagaagatatcttcttctgcaactttcagttcatcctttaagaaacgcagcaggcgtttgtcaatcccactctccacctcaagacggatcacttctccccactgtctcatttttaactgtttctgtatctcttttaacagatcctccgcctcgtcctcatcgatcgtcagatcggcattccgcatgatacggtacggataagcacagagcacttcataatttaagaacagtttgtcaatatttttctcgatgatctgctctaacagaataaaacattttgcattttcttcctctgacgggatctgtaccagtctcggaaggacccccggaacctgtaccgttgcaaaatccagttcctgtttttcgctctttgtattctttttagaaagaagtgccgcaatatttaacgtcttattgcggatcagcggaaacggacgcgatgcatctaccgccatcggtgtcagtaccggatagacattttcctcaaaataacggtccacaaactttttctgttcctcagtcagatcttcaaacgcatctataatatggatctgttctttcttaagtaacggaagcagcgacctgttataagtgttgtactgcagatctaccatctcccttgttttttcgttgatggcagcaagctgttctgaagccgtcattccggcaatgtctttcttcttatagttagcatgtaccatatcttttaaggaagcaacacgcaccatgtaaaattcatccagatttgaggaagtgatactgacaaatttcaggcgttccaaaagcgggatactcttatcgcgtgcttcatttaatacgcggttatcaaattttaaccagcttaattctctgttttcgtaatactgtggatttttaaaatctttttctttttccatagtgtcctccatttaatacacacgtttctcctttaccaccggttttatgctgaatatgttttcaaagtaagaaaccttcgcatcaaacagtgctttttccagtgcgatatcatcatctgtctcgattgtgatcaccagttcttttccttttactgctgcacgcacatttttgaatttctgcttatggctgcggtccatcgcattggatacgcgtaaaattgcagaaagttttgcaatgacaacataactctcacggctgatatcactctcaaaatcttcataggccggcagcggataggtattgtataaaaccgtatacgccacgatctcacgttccatatgtgtaagaccgatgatttccgacgccataataatgtcataggaacacagcggtccgtttgcaagactgatatactttccgcagtcatgcaggattgctgccacctgaagtaaaagccgctctctctttcccagtccatggatttttttcattgtgtcaaaaatcagcgttgccatctgtgtcagtgcatcaatatgcggtgagtagctcatatagcgggcggacagattccttgcagccgagatgacatctgcatcaaaatcatggaccggtttgcatagcttatgcttctgtgcataatcatatgcaataccatcgctcacaatgacacccggtgcccagattttttcggctttcattttgcgcgccatgcatttaaaaatgatcatgtacggaatgatcagggaatcattttcatttgataaatttaattcttccgaaatctgttccacagtctttttgtcaagatcatccagaaatgccagaaaatcattggtttccatcagattttcatgtttcttcccggtgacttttccggcaacctccatgatataatctccgattatgatcagattcttcactttcacctgttccgtgaacattgccataaacacatttaactctttttctaccagttcttcaatctgcagctcatactgctctaagctgcagcttttttttgcaagctgttcctgcatgcgtatggtgccaagtccaagatgctgtgtcgtaatgactttgccctttgaaaagatagtaatctgcatgccgccgccaccgacatccacgactgctgcccccgttttgatcatttcttcaaactcacttcgcatcgcaaccgatttgtagctgataaagcggtgttccgagttgcttaaaacatgtaccgtcagtccggtacggatgcggatctggtctaagatgaacaattcattgctcacatcgcggagtgctgcagccgcatatgcctcgtagccatccacctgatactctttcatgatcttcgtgaactgctctaacgtgtcacagagtgcttccaccagctcatatccgatcacaccgcgtgaatacgcatcccgcccaagctcgatcctgcttctgatataatcaattttgcggatgttttttctggcagagatctcaaaaattttcaggctcacctcataagagccgatataaatcgctgcaaatgtatgaattgccatattttatcctcctgcttcatgcgtacatgttattcctgttttccaagcagataattaataaactgctgtgctgttcttccggagagtccgccgtgggcaagttcccatttatttgcctcggcaagaagtgtctcctcatccatggtgataccgtttttctctgcaagggataccacgatatgctggaattcttttttgcccggtgcaccaaaataaatggaaacgccaaatcttgcatacagagacaacttttcctgtacggtatcggaagtatgcatgtcctctctcacttcctctttgtcggagaatgtctcgcggatcagatgacgtctgtttgaggtcgcatagatcaaaacattgtccggtttcttctcaagtcctccctcgatcactgcttttaagtatttatactcgatctcaaattcctcaaatgacagatcatccatataaatgataaatttgtaattgcggtttttgatctgtgcgatcacatcatttaagtcgcagaactgatgcttgtacacctcgatcagacgcagtcccctgtcataatactgattggcgattgccttaatactggtggactttcctgttcctgcatctccgtaaagcaggcagttatttgcctcctttccgcggacaaagctctctgtattgtcgatcagtttctgttttgcgatctcatatccgaccagatcatctaattttacatgtgcaatgtttgtgatcggtacgatctgtgctccatcctctttatgcagcacacgaaatgctttatgtaagcctaattttccaacaccaaattctccgtagaactctgtaacagcatccttaaaatcacctgcatctgccgcctgctctagttttactgtcagttcacagatacggtcacggattcttttattaaaaagctttccgctgtcgcctgcactctcataatgaagcagtgcatccatgcagtcgatctcataatcttttgccagctctgtaaaatcaaaatcaaataaatctttcatgatcttaaaatcatgcagtgcaatctgattgacggagccttccataccaccccggatctcacacccacggctgtatgcgttctcgttattgaccagaataaatgcaataaaattatgccagagatttcctttaaatccatgacttactgcaagttcggacaactggttaaaacattcgtaaagcagtgcctcgatatcctctctgttataatattcattctcatagttttccatgatccatgccatgttataaaataattttccattttcaaagtttttatataagatcaggttttttgtacttttcatgttttgctccatttcttcgtgtgcaaatcttatttccacacatttctttcgttctaataatttccaagaatcttaagtccaagcgtttcctctgccagacctcttaaggcattctgcactgctgcatcatttaaattaccctcaaagtcgacaaagaaacggtactcccagtttttcccctgtaccggtcttgattcaatgtggttcatgttgatgccattgtaaataaaatgggacagcatatggtaaagggaaccactctcatgcataccttcaaagcagatactgatcttttccgcctttgaagtgaaaacgcgtttgccggatacgataataaaacgggttgcattcatcttattatcctgaatacattcatccagcactttcagtccatagatatcagcagtcaggctgcttgcgatcgccgccttatgttttttgccgtcctcttttactttttttgccgccatggcagtatttttcagactatgtttttcccattcccggtggctctcaagatatctgccgcactgcatcagtgcctgcgggtgggaatagacatccgtgatatcggaaagttctgcatccggaagtccaagcagtgcatgattgatctggataatctgctccccgacgatgcagttatcgtattctaccatcaggtcataattttcagatacgatgcccgctgaagaattctcaatcggaagcaccgcataatctgcctctccgtttttgatcgcctccatggcatcacgccaggtttccacatgataactgtccgtctgctctccaaagtactctctcaatgcaagctggctgtacgcaccctctgtcccctgaaacacaatacgcgcattgtgataatctaaactttccacttctgtaaaatccggtttttcatacattccatgcgctgtcaaaagctgatactggcgttttctgctcatcgacataatctgctcaaacaattcacggatcccgtgtttattaaaatctgttttgccaagtgctgtcagcgttgcaagttttgaatcttcgcgttctttatcaaatacttttttgccggtattgatcttatattctgcaacacccgcagcaatctccattctctcctgatataaatctacgatctgtctgtcaatgacatcaatctggtctcttaattcttttaaatctttcatggattccacctttatttttagtattacttctactatattacattaacgtagcaaaatcaagggcagaaaaagtcatattccatatgaaaaatatagtattcgtgctctgaaaatgctataataaacacagatgagaagcaaatcaaacacattgtcacgtcagcataaaatgctctcagaatggaggccttatgaaaaaagttatcacgattctcttaattatcctcgtactcgccgccggtgtcggttttggtgtctaccaccacaaatcaaacgagacaaaattcaatgacgattacataaacggcaacacggctggcaatctctacaatgccggcatcttctgcacggcagctgatggtacgatttattttgcaaacccttccgacagcagcaaactatactcaatgaacagcgacggttcagaccttacaaagatttctgatgatgttgccacctttatcaatgcagatgacaattatatttactatgtgcgcaacaatccggtttttaccgaaccgttttcatttttgacgatcaatacagacagtctctgccggcttgaccgcagcaaacataaaaagagcattctccttgattcttccgcgagtctttacgcctctttagtcggaaataaaatttattaccttcactatgacgacaaagactttaccactttctatgaagtcggcatcgacggggcagacagtcatcaggtagacaagacaccgtaccgtccatgctccgtcgtcggacagtacatttatttcaatggcgtatcaaacgatcacaatatctggcgttttgacactgttactgacacctcggagctcgttctgaaaggcaattattacatgccagccgtaatcggtgatacgatctttttcttggacaatgaaaataattatacacttgcaagcacagatctctccggcagttcggccatcacaacactcagcgacgaccgcattgactgttataacattacaggaaactatatttatttccagcgcaacagtacaagcactccggcactctgccggatgaaaaccgacggcagtgattacaccgtgattgcagaaggcaattataccaacatcaatgcgacggaaacagatgtctatttcagggattttgcatccggtgtgatgtatcgaacaccgattgctgatccgtctgacgttgaggtctttaatccgggaactggttcttctgacaaataatcctgcaccggatccacaggttcgttttatgttcaaaaaaacacaggggacttccgttatcccctgtgttttttctatgcaaaatcaaacagtgagagctgattggactccggcatatcaccgagcagtcctaaatctcccatcagatcaatgaccgtcttagttgcctttgttctctgtctgaaatcgtctctggataagaattttccatcttttgccgcttccgccacagcgatcgcagcattatctcccataccgtcgatcgtatttaatgccggcatcagttttccgtcaatgatctggaaacggtccggttttgcacggtaaatatcgatcggtgtgaaatcaaatccccgcgcatacatttcctgtacaatcttcatgtcacggtatacatcctgttccttcttggaaagcgaatcttttctgcgctcataatctttctggaaataggtaaggcgctctcttccctgacacatgatctcatagttgaatccggtcgcacggattgaaaaatatgccgcataataggcaagcggataatatactttacagtatgcgatacgccatgccatcataacgtaagccgccgcatgtgctttcgggaacatgtatttaatctttaaacaggaatcaatgtaccactccggcacgtcatgtgcacgcatctcttctttccactcttcctttagtccttttccttttcgaaccgactccatgatcgtaaaggactgctcactgtcaagtcccatctggatcagatagatcatgatatcatctcgcgtacagatcgcagtggaaatcgttgccagtccctgttcgattaaagtctgcgcattgccgagccaaacgtctgtaccgtgggacagaccggagatacggatcagatccgaaaactcctgcggcttggcatcgataaccatctgcatggcgaactctgtaccaaactccggaataccgagacatccaagcgggatcccgccgatatcctccggcgtaacaccaagcgctgacgtatttttaaacaaagacatgaccgcctcatcatcaagcgggatcgtaaccggatcgattcccgttaagtcctgcaacatacggatcatggtcggatcatcgtgcccgagaatatcgagtttcaacaggttgtggtcgatcgagtggtaatcaaaatgtgtggtgactgtcgcagtcgtcatatcgtttgccggatgctgtaccggggtaaaagtattgatctcctctcccaccggaagtacaacgatacctcccggatgctgtccggtcgttctgcggacgccgacacatccctgtacgatacggtcgatctcacagtttctcttgtggatgccgcgctcctcgtaataattcttgatataaccaaatgccgttttatcggcaagtgtaccgatcgtaccggcacggaaggtctgtccgtaaccgaaaataacctcacagtacgcatgcgctttactctggtactcaccggagaagttcaagtcgatatccggctccttatttcccttgaatccaaggaatgtctcaaacgggatatcaaatccgtccttgactagtttttcgccgcagaccggacaaatcttatccggcatatcacagccgctcctgccggaaaatgccttgacctccggcgaatcaaaatcactgtatttacaatttgggcagcgataatgtgcctggagcggattgacctccgtgataccggacattgtcgccgcaaaggacgaacctactgaaccacgcgatcctaccagatatccatcctcgtttgacttccataccagtttctgtgcaatgatgtacataaccgcatatccgttggaaataatagagttcaactcacgatccagacgctcctttacgattgcaggaagctcttcgccatacatactgtgtgccttggtataacagatatcacgcagcatctggtcagaattttcgatgaccggcggacatttatccgggcgcacaggtgcgatcttctcacacatatccgcgatcttgttcgggttagtaatgacgacttcctccgcttttgccgagccaagatattcaaattcctttagcatctcctctgtcgtccgaaggtaaagcggcgcctggtcatccgcatccttaaatccttttcccgccatgatgatacggcggtaaatctcatcctccgggtcaaggaaatgcacgtcacaggtcgcaacaaccagttttccaaacgtttctcccagttttacaatacggcggttgatatcctgcagttcctcgatcgtgctgacggattctttgtcgctttttaacataaactcattattgccaagcggctggatttctaaataatcataaaattttaccagtcttatgatttcctcctccggccgtccacccacgattgcacggtagagttctcccgcctcacatgctgatccaagcagcaatccttcacggtattttacaaactcactctttggaatacgcggtctcttgttatagtaggtcagatgtgacagagaaatcagacggtacagattgatgcgcccgatatcgtttgtcgcaagaatgatcgcatgataagtgttcattttcatgatggtctccggcgaagcctgtcccatctggttgacctgatctaaggtttccatgccacggtcgtgaagcatctttacaaattttacaaagatctccgccgtacatcccgcatcatccacggcacggtggtaattctccagagaaactcccagcgcttttgctacagtatcgagtttaaaacggtttaactgtggcagcaaaattcgtgctaaagcaaccgtatcaatgatcgtaaactctttctcgattccctgtctctcacagtttttgatgataaaactcatatcaaaatctgcattgtgtgcgaccatgattgcatccccacagaactccataaactgtggcagaatcgtctctatcttcggtgcatcgatcaccatatcgtctcggatggaagtcagttcctcgatccggtacgggatcggcacttccgggttgacgaacgtagaaaaacgttctgtgatctcgccgtgcaccactttcactgcaccgatctctatgatcttatttttatccggcgaaaatccggtcgtctcaaggtcaaacaccacataggtatcatcgagattctggttttttgagttggtgatgatatcctttaaatcatccaccaaatatgcctccacaccatagatcaccttgaagtcatcatccggtgagatcgcatggtttgcatccgggaacgcctgtacatccccatggtcggtgatagcaatcgccttatgaccccatttcatcgcacgctttacgatatcttttacctcagagacaccatccatatcgctcatcttggtatgacagtgaagctctacgcgtttctccgggctcgtatccatacggactgaggtaaaatccgggatttttttgatgccgacgatcgaacctatcgtaagctcactgtcaaatttgtcgatggtcgtgacgcctttgatctttaggaaagcaccttttttcaccccctcaagcaattccggaagctggtcatttctggtaaaaatctttaaaacaatggagtccgtgaaatccgtgactgacatgatcacgatcgttttttcattacggatctctctcgtctcaagtgtcatgacctgacagcgtatcgtaacctctcccatctccccgacaatcttctcgattgggatcgtctcatcttcaaaatcttttccgtagagcacatccgggttatctgattttttatatccaccgtaggatccgccatcgtattttttgcggaattcttttttgccaaacgaattttctccctttccgttcgcgtttcctgcattatttcctgcagcagattcttttgaatgattttgttcttttgtggcagttttcgtggatgtgtcagccgtctgtacgtcattcccggcctgtacttcttctgcctttgccggtgcactctcctcatgaagctgtacacgttttaaaatatttttgatttcaaactggatctgtaaatcactgtttttcttgtgtttgctctctttcggttcctcaaaagcaagttctacggaaaggtcaagtccacagcgttcacacaccactttctctaaaaattcaacgatctcatgtgatctggtctgtgcaatgatcgtgttttcaagagtcaggagcagatgggaatctcctgtaaactccattttggcggagcgcagcagattatattccatcagactgtaattttttaattcctctaaaatactgtccttatacagatccatcagtttttctgcagtatactgctctgacaactgatatttttcaatgactttaacgtccatatgccggtttttaaaaatctgatcatgtatgtttttttccagctgatagatattctttttatggataagacgtgttccatttaaatagatacggatatgatctttctcatgattcattccgaccttggtaacttccgtctctgataacagttttttcatatctccattcacttccagtgtcggaaatacatcaaaaaacatttttgtcatgttttacccaactccaacttacttaattgttgcttgttcacacattccgtgtgaccagtaacacctaattttcattccagtgcagcagttcatagcgaaggctctctaacagttcggattccggcactttcttgtagacctctccatgtttgatgatcagtccttccccgatacctccggcaattccgatatccgcctcttttgcctcacccggtccgttgaccacacagcccataacggcaactttgatgtctaacgggatatcggcaaccatattttcgacctggtttgcaagtccgatcagatcgatcctggttcttccacaggtcggacaggatacgacctcaataccgcccttgcgcagtcctaatgtctttaagatcagctttgcggatttgatttcctctaacggatctccggtcagtgaaacacggatcgtatcaccgatgccctgatgtaaaatcagtccaagtccgattgcggatttgatatttccactgatgatcgttccggcttcggtgatgcctacatgcagcgggtgatcagttttttctgcgatcagctcatgtgctttcacacacatcataacgtccgaggatttgatgctgataacaaggttatcgtatcccatatcctcaatcatttttactttatccagcgcactctcaacgattccttctgccgtcacgccatggtatttttctaccagatctttttctaaagaaccactgttgacaccgacacgaatcgggatctgccgctcttttgccgcatccacgaccgcctgtacgcgctctctgcttccgatgtttcccggattgatacggatcttatctgcaccgtgctcgattgctgcgatcgccagacggtaatcaaaatgaatatctgccacgaccgggatctccacctgttttttgatctctgtcaatgcttcggcagcttccattgtcggcactgcacatcttatgatatcacagcctgctgccgcaagtttattgatttgtgccactgtcgcagcgatgtcctctgtctttgtatttgtcattgactgaatcaggatcggattaccgcccccgatcactttcgaaccgatttttactgtttttgttttcactgtactttcacctctacatgaaaatttttcgaatatcgttaaacattacaaccaccatcaaaagcattaaaagcataagtcctataaaatgcaccatgccctctttgtccggatcaacctttttcccccggatcgcctcaatgatcagaaacaccagtcgtccaccgtccaatgccggaagcggcagcaggttcataacaccaaggtttgccgagatcagaatacagatatagagcatttgtaaaaatgccgcataataaccgtaggaaacactctcctcatagctgtcaccgatcgcatcgacaagcccgaccggaccactcatatcatttaaggtaacaccgcctgtggcaagcatttttaagcttccaaacgtcgtatcgatccagtattttacctcatatccactgtacagaagattcttaaacacatttcctttctccacttcaccgccgacaaaaccatagcggtatctgccaagttcttcatcatacagaggtgtcagctctgccgtatatctttttccgtcacgctcataagtcacttccacggtctcccccgcatggaacatggagtaagaactgacttcccggtaaaaatgaatatgttttccgttcatttttacaatgacatcccccgcctgcatacctgcctgttccgctgcaaagccctcgctgacctctgtgatcttagggacatcatatccattgcaggaaagaaggataaaagaaaagacaaatgccatgataaagttaaacaccggtccggcggcaaccacactgatccttgcccagacagactttttgccaaatgcccggtcatctgtactctcgccgtcttctccctccatcatacaggcacctccaaacggaagcagttttaaggaatatttcgtttctcccttcgtcacgcccaaaatcgtcggtccaagtccgagacagaactcattgacacggatcccatttgcctttgccagtgaaaaatgtccaagttcatgaaatataataatgatactgaagatcaataatgcgataataattttcatccgtttttaattcctttccattctgcctctaagcccatttctgcccgatatattcgtatactgcctgctctgtttctaatacctgatctaaagtcggatcgctgatatatgccacatgctccatgcagtcctcaatgatctccgtgatctgcggatagctgatcctacggtctaaaaacattgccactgcacgctcgttcgccgcattaaatacggttggctgactgccaccctttctcattgcatcgtatgctaacgccagtccccggaaggtctttgtatccggccgttcaaacgtcagacttcccagttcaaaaagatccagtctctttcctgacatttttctgcgctccggataatagagtgcatactggatcggcagacgcatatccggtgttccaagctgggcaatcactgctccatcctcatactgcaccgcagaatggatcacactctgcggatgaacgaccacttcgatctgatctaattccacaccaaaaagccattttgcctccatgacctcaagtcccttgttgaccagtgtcgaggaatcaattgttatttttcttcccatcgaccagttcggatgttttaaggcgtcctccactttcatctctgcaagatcctccgcgttttttccgcgaaatggtccgccggatgccgtcagaaggattttttcaatacggttgctctcattgccctgcagtgactggaaaatcgcgctgtgttcactgtccaccggaaggatcggcacatgatattcttttgccagcggaatgatgatgtgtcctgccgtcactagtgtctctttatttgcaagtgcaatttttttgccagctttgattgctgcaactgtcggacggatccccatcatgccaacgatcgcggtaactaagatctcactctccggatgaactgcgacttcaatcagtccttccatctttgaaaccacttttgtgtccgtatccgcaattttaatctttaatgcttctgcggcttcctctttgaaaacacataccagtttcggggaaaactccctgatctgctgctctaataatgtaatattacttcctgccgcaagtgcaacgacctcgatatctttctgttctcttacgatatcaagtgtctgtgttccgattgaacctgtcgagcctaagattgctatttttttcatacaaatcctcttttctaagcaacttgttgcgaagaggcgacgagaatctcaaattctcggaggcatgttttttatgccttgccatcaaagctatttgttttgctcagaaacaaatagccgtgcgaaaaataagctatcaggcttatttttcatactaatatcctctgtttacaatacaataaaatttgctgcaagaaaataaatcatcggcgccgtaaaaatcacactgtcaaagcggtccagaataccgccgtgtcctgggatcagttttccataatccttgatctcatagtttctcttgatcgcagacgcagtcagatcacctaccatggagatcaacgctccaaccgcactgatcgccgccatgatccatacatgctgtgtggtaacacccatcgcatttttaaagatcatgccatagatcacagttaaaagtgcagcaccgaccactccaccgattgctccttccacagattttttcggacttaacttcggagacattttatgttttccaatcagcataccaacacagtacgcacaggtatcacatccccaggagcacaaaaagatcagccatacgatataggcacccgcggtgagcattctcgtctgatatacataagaaagcatcacagccacataaaacacaccgaaaaatacagctaacatctgctccgtcttatatttcggataagtaaatacatagacaaacatcaatgccatcaggaatcctaaaacgactaccataagatccggcagaaatgcccatttcagattacagtaaaatacggtcgccgcaagataccccacgattcccggcagttctttttccacatgaaaaatgcggtataactcaaacattcctatataggaaataagtaacgtcgaaaagagtaacacatctccccccgtgataataagtactaacgcggctgccaccaacacgatgccgctcaacagtcttgtcttaaacatatatgaaaacctgccctttcttctttcggtctatttcgcttcctctgccagtccgccaaatcgtctgtctctcttattatacgcttccacagctttttctaattcctcttttccaaaatccggccatggcacatcggtaaaataaaattcactgtacgcaagctgccataacagatagttcgaaaggcgctgctccccgcttgtgcgtatcaaaagatccggatccggaattcctgcagtatccagatatgaggcaaacagatcttcatttaattccgaaacctgccttgtaccattctccatatcctgacacatttttttcattgcgcggatcatttcatccctgcttccataattgatggcgatctgcaggttcagaccatcattttttgcagaagctgcttccagctccacgatctgtttctggaaccgggcactcaaacgtgtggtatccccgatcacgcgtacacgcatattatttttatctgctgttttaatacagttcttcagataactttccagcagcttcatgagtgctgccacctctccctccggtctgttccagttttctgtcgaaaaagcatacatagtcagatatttaattcccatatcatgtgctgctttgcagactgtttccacattttttgccccaaccgtatgaccatagtttctgggcattcccttactttttgcccatcttccgttcccgtcaaggataattgctacatgctgcggaattttcattgtaatcaccacgcctttccataacctgcatactttgtgcctgcattcattcataaagtgaaaatgaggacacgccattgtcatgtcctcacctctatgttctatacaaaaatccctaaactgtcaggatctcttttgtttttgcctcaacagccttgtcgatctcagtgatatatttatctgtcattttctgtgcgccgtcctctaactctttcacttcgtcctcggacacatcggcagacttgcttaatttcttgaaagaatcattggcatcacgacggatattacggattgctacttttgcattctcgccttttttcttaacatcctttgccagttctttacgtctttcctcagtgagttccgggaaaagaagacgaatcacttttccatcatttgtcggattgattccaagatctgacgttaagatcgctttctcgatttcttttaccatagaagcttcccatggctggatctgaatcattctcggttccggaacattgacgtttgccacctgctgaattgcagtcggtgttccataataatcaacttttaacttatcaaggacatgcggattggcacgtcctgcacggatgcttccgaactcctctgacaggttattcattgttttctgcattttttcatcaaactgaactaatctctcatccatatttttactccatacctttcacggttctttgttacacggttacttttgtaccgttaaaatcgccagtcatggcttttacaatgctgttttcctcgttcagtccaaaaacgaacatcggcattttattttccatacacatgatcgacgcagtcaggtcaaccactgcaagtttacgatcgatcacttcctgtatggatacttcgctgtattttacagcagaaggattgatctttggatcactgtcgtagacaccatcgattgcttttgcaagatagatgccctctgcctccatctcaatcgcacggagcacaatgcctgtatctgtggagaaatacggatgtccggttcctcctgcaaaaaatacgaccattcctttttcaaaatacttatttgcacgatcctttgaaaacagttttgtcatgcttccacactcaaatggtgtcaggatctgtgttttcattccaacggaacggaaaatttcagaaacatagatacagttcataactgttgcaagcattcctatctggtctgcctttgtacggtcgatggtttcactggttcttcctctccagaaattacctccgccgatcacgatgccgacctggatgccctgatctgtaatctgttttacctgtcttgccacttctgtgacagtcggttcatcaaatccggtatgtttttcaccggctaaagcttcaccgcttaattttaagaatactctcttcatattcgattactcgtttcctttctgagcattaccattgaacaggctctgtacatccacgtcagaatagcactgtgagcagaatccttcgattaccgcaccattgttgatctgtacagaacgtgatttgatgttacccataacaactgcggatgtatccacaacaaccggtccctgtacatcaatatcacctttgatggctccggcaatcactgcagaagtagaggtcacattaccgatgatcacagaaccaagaccgatcttaatggttcctgtactgacaacctctccctcaatctttgcagcgtctgcaaaaaattcagatgcactgctgtttccatttacaacgccggttacaactaatttgccgttgcatcccacatttccttctacctgtcctcttacatccaaggaaccgtttgatacaatatcacctttgatgatcgttccctctgtgattacggatacctcatcagataccggtgcgctctggttattagttacaggtgctgttgtattgtcagccatttttctttcctcctgggttgcttttgtaatatttgaaactgtttcatttctttctggttcaggtacagatgcaggcacaggtactgctgctctttctgtcggggcacttgcattccttgctgccatctctgcggcgcttcttgctgcagcaactttctcagcttcctgctttgtcacctgttccaacagaccatccagcttggaaagttctgtctcaacatccacttcgccttctaacgtattaacctcaacgtcatcttcgttcgtgctggtttccaggttgtcatctgcaggcatcagttcattgactgcctgtgagaagtcatctttaaaatccttgaaaaatcccatgttcattcctccatttattctcagttattccactgtgtctgctttcacatactgaataacctgtgtatcttcatcaatcggtaatatttgtgcgcccattccctctaaagcttcaatcaaaggtcctaaagcttctaccgttgctgacttatccgttccgtcatgcagtaaaaccaccgacgttttatattttactacatcatctgtcacattttcaactatttcctcagaagtatatgcggtcgaggcgccatctcctgccgatacattccagtcataataaataattccctgtgtattaagataatgaataaagtaatccatcggtacgttactgatgagattgctgcttcctcccgggaaacgatagtaaagactatccactcctgtggtctgtttcaaaaaattcttcaatgtcatataatcctgttcgaacgcatcttccgactggtagatcacactatactggttggaatacgaattcatgccaagtgtatgtccctcatccacaatacgttgatagacagaaagcatttcttcatcctggtttccattcacaaaaaaagtagcttttacgccatatgcctgcagcacatccagaatctcagatgtgtgttccgacggcacattatcaaacgttaagtatactttatgtatatctccctccgatgccagattgtcctcatcggaaatcccggatgcaggaggtgttactttatcccatgtcatctccgtctgcatctcttctgttgtctctgtctcctctgctatcacaccaccattcagatctgcggccgctccggcattaatctgatccgtgttctgctcactgctgcttgtcaccagctgatccagcttatgttccagcgacgtcatcttcacaaatagcaccacaaccaatatcatggacagaacgatccatcctgccacaatcagtatgatactgtatcggattttcgtgatccgctttctccgctttctctggtaattcagtacttctgaatctttatcctgcatacaatacccccaaggtaatcgttagtacctatctattgtaacacatttttctatttttcaaataaaaaagcgcaaaaaaattgattaattttttcgcactttttttattattgtctgattatttttatttctattgtactattttattttccaagtatgtttgcaataaaaaaaccgccaataaagagtaatattccaagcagcagctgtccaaaaccgatagaaacgatattcatcccggataacactgcaatcggcgatgaagtgaccagccccataattgcaaaatacgttttcctctcctgtttcttcaataaatattccacaagttttgatacaagaaatattccaagcaccacaccgataccaaatgggatgagcactgctgcacaggcgaacagctcctcccacttaagagccggtaatgctgccaaaaaaccgctgattctgtttatgatcggcgtataatatcccagagacatcaacagcattgaaccactgaccccgggaatcaccatcgttgccgcagctaccgttccaaccacaaacagcgagatactgttttttattcccggctctaaggcaacatctgttccctgtttccagaactgcatccagacgaccagaccaaaaaacaaaacaaacagcagcgtctctgaaaatgtgatccgctttcccatgattttgggcagcaatagcggtactccgccaaagatcagtccaataaacagcattgccgtctcaaatggaaattccaaaaagaaatacccgattgcaaatgacagtccgccgattccaatcagcatgccaatcgcatagggaagcaaaaactttacgctcttccagaaatgttttggcattcccgttaccgccccgatcacatccccataaatccccatagaaaccatcatggttcctccgctgacacccggaatgatattggcaacaccaattgcaattccgcgcagcacctcttttaaaaatgacatatccatcctccaaatcctgttattctgccaatcttacttctgtcatctcttgtgcaatgtttaatgcatgatctccgattctttcaaaatccgtgagcatttccgtgtagagaacactcccttcacccgatgccgttccttcctgtatccggtgcatcatacgatttctataatcctctgtcatgtcatccatcttttgttcgagtgctgagacacggcttaattcgtcgagtgcctccatattttcatttaaaagcaaagtcagaagttcttcgcaggtctgctgcatctgcaggatttcttcccgtacttcctgtgaaaacctgacatctttttctttcagccactctgaatatccacagatattcattgcatggtcgctgattctttctacgttactggtcactttaaaataggcacttaaaatcctgctcccccgtgtattggactcatgcgccatatttgtggatatgtacttggagatctcccggtttaaaaagtccacatactcttctttttcttccacttttggaataaacccgtcatcacagtttaaaaatgccgtaaaactgtctgagacatttttctttgcaatctcaagcattcttgcaatctctttgtgtgtcagttcaaaattgatcgctgatacaccaatttttccctctgtcaccggttttgtattttttaaatattttaaatacatcccttcctcaggctcgtccacgtccggcagaattttttctgccagttttgccaatagatttcctgccggtaacagcaatatcgttgttacgatattaaacagcgtatgcatgttggcgatctgcgcagccggatttgccggtgtaaatcccccaacccaggatgtcagcggtgtcagcatacagagtatggtaaaaactgcagttcctatgatattaaacgaaagatggaggattgtcgtccgctttgcgttccgccctgtaccaatggacgctaacactgccgtgatacaggtaccgatattttgtccaaacagtacatacaccgccccggaaaaagaaatcgccccacttgttgcaagtgcctgaaggattccgaccgatgccgatgaagactggatcagtgctgtaaaaatggcacctgccataattccaagcagtggatttgaaaacttcgtcatcatatcaatgaatgctttggaatcccgcagcggcatcattgcggtgctcatcatttccattccgataaaaagaacaccaagaccagctaaaatacctcctatgtttcttaccttcggctgttttagaaaaacaaccagcacaacacccaaaaatgctataaacggtgcgattgctccggcatcaagtgcgatcagctgtcccgtgatcgtcgtaccgatgttagcacccatgatcactcccaccgcctgtcgcagtgtcatcattccggaattaacaaaacctactaccatgactgttgtcgcggaggatgactgtatgatcgcagtgatcactgctccgactaaaacacccagataccggtttgtagtcaggcgttctaagatctgtttcattttgttcccggcagcagcctccatcccctggctcatcatattcattccatacagaaaaagcgccaagcctcctaacaatgatgcaaattcttttgctcccattttatccctctttttttcgttattacggcatttttctgctgtccctgcgggcgctttactgccgctttgccacatactcactcaacatatcagacgtatattttaccgtcaaccgggatatcggattcttaacgcttcctgtattgtttttatgaagtttttgtcaattttgtgtaaacaatagaatgttatgccttcagcagaacgactgctgtttcaaggctctctaatgtaatatgatctgcatctgccagttttctccttccggcatttgacagcaaaagttttttggcagttccaggcagtggcagacttactgcctcttttccgtaatttgctgccacgagtattttctgtctgttttctttacccatacgcataaatccaaacactgtatccgtatcttcgtaaaccggctctacatttccatagacaaatgtttcttcgtattccggtgatttgcgcagtgtaatcagttctttataataggaaagtacagagtccgcccttccctcctgctcactgacattgatctctttataattcggattcactgcaagccacggagcatgtgcgctaaaacctccattttcatctgcactccactgcatcggtgtgcgcgcattatccctgctgttttcatagcagcatgccaacgcttcttcttttgtgcagcccgcgtcgatcgcaacctgatactgatcttttgtactgatatcatcatattctgaaatatcatttctatgacagtttgtcatgccgatttcctgtccctgatagataaacggaattccacgcagcagaatcgaagtcgtagcaagcatttttttgcccatttcattctgcgcatattccggaagataacggcttgcacctctcggctcatcatgattttcaatgatatttgccttgaatccaatcccctccatctccttctgggacgcaaacagaatctctctccaccgcttaaaatccaccggtttgctgtcataccagccatgttccccgtaagtcagctcatgcgcggagaaatcaaacatacttgagaaatgcccatcatctccgacaaactcccgcagttcgtcctctttcatattaaagacttcgccgacggtaaaagcatcatatttctcgaaggtctcatgtttcatctcctctaaaaattctccgacgccgtccgtctcctcaaccatttttacacaggataccagaccatcatccccatcgggttcataggacgggaaactcgtatctttcttgatattaatgattgcatcgatgcggaatccgccaagtcccttatctaaccaccagttgatcattttatagatcttgtcgcggacttctttattctcccagttccagtccggctgttcttttgcaaacatgtgcagataatatttatctgatcccggcaccggctcccacgcttttccgccaaaataagaacggtagttgctcggctcttttccatctattccttttacaaaataaaaataatcggcatatggcccgtccgggtcggccagcgctgccttaaagtattcatgttcactggaacagtgatttaccacgagatccatcacaatatacatatcgcgtttttttgcctcggcaagcagctcatcaaactcttccatggttccgaactcttcggcgattttatagtaatcagatatgtcatacccctgatcaacaaacggcgatttgtagattggagagagccagatgatatcaatgccaagttcttttaaataatccagttttgagataattcctctcagatcaccaatgccgtctccgtttgtatccagaaaactctttggatagatctgatatgctaccttgtcatgccaccattttcttttcatttttttcctcctgacacattttatttcaatattcttttttatattttttgcataattctgttttctttttcagctgatgtaaatattatatttgatttttattcgtttttcttgcattatggttggataatattgtacaatactgctatcatagttgcccgacaaatgctggtttgtttatgaaataaatcgcccgtcccaatggtgtgtcgcaggtctatgagtggcatcttgcgcaaagccggagttaattttggttccgttgtacgaaaataagaaaagtctaagtgtgtctgagttagattttctcggagtgacgtgaccggcgttcaacgagccatccgtggctcgtgaagccttgttctgccatccgtggcagaacatcactgtgtatctacagacacactaagattttctaattttctcccaaagtcacaaaatcagctcaggctttgtgcaagatgccaatcgtcaggttgtgaacaccatttgggtgggcggttcatctcaaaatctgggggcgtaggtgcgaattttccagtattatcaaaccaataataatctattaaacatagttatttggaaatatttttttaacagattcagacataaaaacactaaaaatttacgcaccgcccaaggttgtaaaatgagttctccggcgaagggtggttcacaacttagtggctggcaaatcgcatcaagccaggactcgttttgtgactttgggagaaaattagaaagtctttgtatgcctgttcacaatacagtgttgtgctgccacggacggcagcacaagtcctaatgtgcccggacggcacatttaggacgcacacgtcactccgcctcaacctgaatcaggcatacttagactttcttattttcggacaacgaaacaaaacagtcccggcttgatgcaatttgccaatcgtaacccccagaaccaccctacacagggaaactcatatcacccacaaaccagcatttgtcgggcaactcatgcttggatatattgtgtattttcaggtagtaaaaaagctggcagcagattcgcatatacagaccgaaatctgcaccggcagaatggagtttttatggcaatcagtttatctttagaccaaaaagaaaaagcaaaacacggcgaacagctatttccattgcagcgttatatcacaaatctttcctccacttatccggcagtcactgcacactggcataaagaggctgaatttaccatgatcacagacggaaactgcacttatcagatacagctttgcccctaccctgtcaatgcaggagatcttatatttgtgcctcccctggttcttcattccatccattccaataccgatcctgcaatgacttccgagacctttgtctttcatatgaattatcttggcatgggaaatgcggacatctgcgcggtaaaatatctcacaccgcttgcgatgcaaaaaatcatcccgccctatatcataaaaaaagaacatccagtctatgcggatgccctgtcaatattccataaaatcagtcagctttatcacgccaaacccatcggctacgagctaaggatcaaatcactccttttagaactgattgctctcctgctccctttctgccaggaggattctgcattttcccagctttccaatgaacataccagtaaattaaaagctgtgttagaatttatcgagcagcattatgctgacccgttatcggtcgcagatctcgcatctgtctgctgtttcagtgaatatcattttatgcggtttttcaaaaaatatatgggagaatctgccatggaatatgtacggaatgtccggttggcgaaagcagcagaactcttcgaacagggtgcacaatcctcgcttgaggtctcactctcctgtggatttaacaatctgtcctattttcaccgggaatttaaagaaaaatatgggatgacaccgggagcttttcagcggaggatcaatgtttagatgatttcctgtcataaacagatgtttttacatcgaagcataaaataacccttataaacgatgttaccaccatttataagggttatcaatcttttcagaaacttaatacaaaaccaaattaagcgttcatctgagctgcaacttctgctgcaaagtcttcctgtttcttctcaagaccttcacctgtctcgaaacgaacaaatctcttaacttttacagtacatccaactgctttagaaacctcatcaaggtatttagcaactgtctgttttccatcctcagcttttacgtatacctgatctactaagcatacttcttttaactctttgctgatacgtccttcgatcataccgttgatcactttctccggtttctgggactctttcggatcgttcatgatctgagctaaaaggatctctttctcatgtgcgatgtaatcagcgcttacttcgtctctggaaacgtattttggatttaaagctgcgatctgcattgcgatattaaccatagcttcttttacagcgtcattgacaacatctgtatcagcatctacgataacaccgattcttccgccgccatgtacataagaaactacgcagccatgctctgcaacaactttttcaaatctacggatctttaagttctctccgattacagctactttctctactaatgcatcattaacagtcttagaagcatcctcgttccatgcctcagccatgaatgcatccatatcttttgcatcagagtttacagcctgtgctgctactgcttttacgaagctctggaatgtctcattcttagcaacgaagtcagtctcagagttaacctctacaactgctgctgtcgtatcatcttttacaacaacggtgcaaagaccttctgctgcgattctgcttgctttcttctcagctttagcctgtccgttctttcttaagaactcaacagcctcgtccatgtttccattggtctcgtttaatgcttttttacaatccatcatacctgcgccggtcatctcacgcagttcttttaccatagctgctgtaatagccatttttcaatcctccaaatttatattttatgatataaaagggacgttaacctgcgtcccttttgttttgtcacaaatgacaaatcttatgcttcctctactgcctcatcagctgctgcagactctgcttcttctgcagtcatctctgcaccctgatttgcctcaataacagcatctgccatcttagatacgattaatttaacggctctgatagcatcatcattacctgggatcacataatctaactcttccggatcacagtttgtatcagcgataccgattaatttgattcctaaagtatgagcttcctggatacagattctttctttcttaggatctactacaaagattgcatccggaatcttcttcatctctttgataccaccaaggtttttctctaatttttcccactcttttttcagtgcgataacttcttttttcggtaatacttcgaaagtaccatctgttgccattgtctcgatctcttttaatcttgcgatacggctctggatagttctgaagttggtcagcataccacctaaccatctctcatttacatagaacattccacaacgctctgcctcagttttgattgcatcctgagcctgcttctttgttcctacgaaaaggattgtgccacctgctgctgcgatatcagatactgctttgtaagcctcatctactttaccaacggatttctgtaagtcgatgatatagattccgtttctctctgtgtagatgtatggagccattttagggttccatcttcttgtctgatgtccaaagtgaacacctgcctctaataactgtttcattgaaataacgctcatgtttctacctcctggtttttgttgttataaaaagctgtgcgtccggctttttataagttgcttccatgtgtttcattctttcaggcgaccatctggcaccagcctgtcggtccacacatgtgtttactcggaatattcttttattccgtcataaccttgcaaattataacacacgccccaaccagaatcaagtacttttttctgattagggcgtatttttctcatttactctgttttattgctgctgttgttccattggaccggcttttaaaatatttgtaatttcttcataagatgcatgatatggaatctggtaggttcctgcactgataaaggaagcataaccaacctcacttaaatattttcgcagtccttccgaatcatcgatcacaccattggctgcaagattttcgcacattgttctgcacacatccccacggtttacaaccagtgtgaacggttcctgctgtgtctgttccgcgttttctgcattttcagtatccgataccacagactcctgcggagtttctgtttccggttccttcggcacttccatctgtgtttctgtctcctgctgtaattcctcggcagctatctgctgttcgtttttttgctccgtctcttccggttccgtggtttctgtttctgcaattaccgcactattctgttccggcataatcataccaagctgtgcagccttttctataatctgttcatccgtcattttaggcttctgcatcgaaaaacagcttaccagaatgatcgttgtgacaataatacctatgccaagtcctcttaaataatattttagtttcacgaatctgtatcccctttataaagtccaagtacaagatttacctctccgagtcctaccccaagtgcctttgcaatctcaacactctgcattccctttttacgcatttcgaggatcctgcctgtatggttttcctccgtttcaggttcttcttccttttttaagaccgggacttcctgctcttttgtttccactttttttgctgccggctccggctttggcacaggtgctggctccgctgcttttttctttgccattccttcctgtatgctcttgacatttgctgcaatcttctgtaaatccgtagcaagacctgtcagttctgtgtgtttgtcattcagcatattataaagaaacataatctcattatgcgtcttattcatattttccataaccgtgtcagaatattcgctgatggccatgattttttcatttgtttctttttccaatgccctctccacctgttctgaagaagcatcaatctgtgcctcaattgactcttctaccttgctcttagcatctgctaaagcaccatcaatgatcctgcccagttcatctttacttaattctgcaatcttatttaattcggaaggagataaacgttccgtgataaaaaagcttccaaccataaaaacaacccccgtcagaagcaaaaaaaatactattccagtcatatcaaccgttatgcctttcattatattttgacatcaaagctggtcctgcgttccttaatatgaacacttccttcatcctcatccggctggccatgcttttttttcttttttccattaccgctatagctgttattccctttttcccgggcatcgtatcggaattcctgattgtccttctgttccggatcctgtactttgtgtgataaatcagattcctgtttttcctgccttacttcaatgttatactgatctgcaaccggtctgctatcctccgcatgcttaatattgccaatatcctgcgttcgttgtatcataccgctcaaatcaactggtcttatcgacataacatatcacctccggacttactgtcagtcaatcagtattcccatatagtttcccatccttttgcgcatttttaacaacgcttttgtatgaagctgtgaaacccttgattccgaaacttccagtatgctgctgatttcttttaacgtcatatcctcataataatataacaaaataacctttttctctttttctgtcaaaagctccagcgattccattaaaaccttttttagttcttcttcctgaacagactcctcaggctgaataaaatgcgaattgttttttgcatccatcacaggttctccaccctgttctacaaattcattcagtgagataacatttgtaacattcaactgtgtctgccagtcatttaattcttcctcaccgattcctaattcttgtgctatttcttcgtccgaggcatttcgccctgttttggtttcaatctgcttgatcgcttcctcaattttcttgcgtttttgccgcactgtccgtggaatccagtccatttttcttatctggtctaatatggatccacgtattcttaagcttgcataagtttcgaactttacatcctttccgcgatcaaatttgtctatcgcgtctatcagtccaaatataccatagctaaccagatcttcatactccacgttatatccgagatacatgctaagccgccctgccacaacccgtacaagcggagcatactcgataataattttctcccgcagctctgccgaaggatttttctgatactcttcccagagcttttctttttctaccgttttcatatgaagcccccacgtttcagttatttctcatcctgctcatcgctctcctgctctggctcttctttctcttctgcctctgccggagtttcttcaccatccgtggtttcttcttccatatccttaaaattcttatcaatcaacagttttacaattccgccaatgatataaaacacaatcaggacaaccagcagcatttttacaaatctgccggtttccatatgtcccgccattcctgcaatgcagaccacaagtcctgccacaagcataacgatcgctggtatcggctttgttttcataatgcatccatgcctttctatcagataatctttaacggtttacctaccgacttgatataaaattccccggtatcacaatgaagttcaactgtgcgaccataattaagtcccgtatcttctgcaacaagcctgattccaagctgctttaattttgcttttgctgcctctgcatttctcgcaccgatattaccaacatctgacaatccacttacctcaaacattcttgcacccccggcaatcttagcgatcaatctgcctttatttgctcctgctgcaattacccgacgtaataattcgtcaatccccgtatctgcaaactttgcgatattactgttatttctgacctttgtactgtccgggagcatataatgaaccattcccccaacttttgataccggatcataaaataccagaccaatgcacgagcccaatcccaaagttgtaataacatcaggggctttacatacattcaaatctgccatgcccacttttattacttcgctcatatatccttctccttacaatgagattccaagtgacgttaatatcttttcataggatccctgctccggcatcagtataaaatatccgttgatcgccacgtctgcgcagatctcggtctgaatcagcagtgcattatcaccaaactgtccaaactcaatagccggcacacttaagatagaagctgccatatccaccgcaatatatggaacagacggagaaatcacaagatttgtcatagaagaaagagctgacaaataagaacctgcaatgatgtttcctatttcttttaatgcggatagttccatttcgtcaaacggtttgtccgctggcacatcttccatcatcagtttgttgacaagataacgtgccgatggaatatctaccagaaacatcatactaccctcgatgtcattcattacctctaagaaaatgccaacaattgtttcatcctctgcaccgacagcagttcccaattttgatacttccatcagttttacatttggaacattcatgtctattttcatgcccagcatatttgcaattgccgtagttgcatttcctgcaccgatattgccaatctcttttaagacatcgagatacatattatttacgtcttccaacgttaaatttcccatgaattgctgattctcctctcattttgcacaccagataaaaatccggtgggactttacattctataaaatcccacctttttattaattattttcttctaccagtgcattgatctcaagcagagaaatcaactgatctccatgcttgccgattccattgataaatcttcctttattggaaactttatcaatttcatcctcacttaaattcacaacttcccttacctcatccacgatgacacccagggaagcattttcttctaattttaagataatgatcctgctcgcatttgtcagaacatcatcttcaagtcccattttcttacgtacactcataaccggaacaacctcaccacgaaggttaattacacctttaaaatatgtctgtacttttggaactcttgtaattttctgcatgcggacaatgttatcaatatagctgatatcaattccatactgctcactgcccaccataacaacgatatattgtttggattctttttccgttgtttcaagattattatttgccatgctaagtaccctccattacattaacgtattcacatctaagatcaatgcaacttcgccatctccaagaatcgttgcaccgctgatcagtttgttattgtcaatgtattttccaagcgacttgattacgatttcctgctgtccgatcagattatcaaccacaagacctgccatactgtcacctttcgttacaataacaacggtcaggctctccggctcttcccttggctcaagatcgagcacattgtcaagtcttactaacggaataaccttgccacgcagatgaattacttcctgagcttccacatatttgatatccttaaccggaatatcttcaatgttggagatggaaccaagtgcgatcgcgtatttttcatctcttacttctaccatcagggcctggataattgcaagtgtcagtggcagacgtaccgtaaaggtagttccttcgcccattgcagtcttaacttcaacatctccgcctaatgcctcaatgttagacttaactacatcaagtccaacacctcgtccggaaatatcggtaatcgtctttgacatagagaaacttggcaggaacaaaatgttgatgatgtctttctgactcatgctctcagcctgttcttctgtgataattcctctctcaatcgctttatcacgtactgcagccacatcgataccggcaccatcatctcctacctgaatgattacgttattaccttcctggaatgcatttaagaaaatgcttcccacttccggtttaccgagggcaacacgtgtctcgttatcctcaaggccatggtctgcggagttacgcagtaaatgctgcagcggatctccgatctggtcaacaacggtacggtcaagctctgtatcttcaccagtcatgtaaagttccatcttcttattgagctttcttgaaagatcacggatcatacgagggaatttatttacaacgctctcgattggaaccattcgaactttcataactgactcatgcagatttgttgtgatgcgctccagatactcgatctgctcatgataggtctggttctggaaatcaccggactcagtggatccgattgccacaagactgttctttgcaatgataagctgatacctggttcatcaaggcatccagcttttcaatatcaacacggacagtacggtttgtcaccggttttgcaacagtctgtttcttattgttctgggctgctggtgcctttgccggtgcaggttttgtctcctgagccggtgctgcttctgcctgtgcagaagcctctgtctttgcggcttcctctgctgcagctttttctgcctgtgcctgtttttcttcaagcacctcacattttacttcttcaccgactactttttcaatttcagatacagactgggctgcctgtaaaatcttgtcgtaaggttcttctgatgtgatgaaaaaactgaaatcattatcaaaatgctcatcttcgatttcctgtgaagttggattgtatacaatgatttctccaaattcctctactgccttgaatactaagaatgcacgagcagcttttaacagacattctttctgaatatatacggtcattccataaatatgtaaaccattgttttctgcctcttttaactttgtgcggtctgaactgttcagttcaaattcaaaatatttcttttcaccgttcttagccgcatcatctgtattttcttccttaggagccggagctgcttcctctttcttctccgcattctcctcaccggcgataaaatcattcagttctttaatgatcagctcgttgtcttccgttccctcatcggaacttgcctttacattgttcagataactctcgatcgcatccagacatttaaagagcaggtcgatcatattactgttaactttaactttatcacttctgacttcctgaaaaacattttccatatcatgggtcagtcgctgcatgcgcttaaatcccatggtacctgccataccctttaaggaatgggctgcacggaaaatttcatttatagtatccatattttccggttctttttcaagttccataatgcagtcacttaaagtctgcagatgttcttctgtttcatcaataaaaatttcaaggtattggcttacatccatattactgtacccccacattctttgttattgtttgagcaacctgtgtaagaggaaccacttcatttaccagtccggtttcagcaatcgacttaggcattccgtataccacacaggtctcggcattctgcgatatcacatataccggcttactctttgctaaggattttattcccttggtaccatctgctcccataccggtcagtacaacacacactatctgatcatatccacaggttcgcaacgaatcataagtaatgtctgcacacggttttaatccgccgataggaggcaattcatcattgagtctgattttatggcttccgtcaggacttttctttatttccatatgctttccgccgggagcaatatatatcgttccctttttgagcacatctccatcttccgcctctttgacatgtatgtcactgacttcgttaagtctgtctgccatggattttgtaaatcctgcaggcatatgctgcactaaaaccatcggtgcatccagatttttaggaagatatggaatcacactctgaagagctttcggacctcccgtcgaacatgccaatgcaactaatttatttctgcttcgaaccggctccgtgtttctgcgcaagactactttttccggtgtttcagccgatttgctgcccaaagccatcttctgtgtttttaaaactgcattcagcactccaagaagtttacccttaaatgcttcaccttttgcctcgatcacattcgtcggcttcggcacaaaatcaactgccccacgttccatggcaagcatggtaacttcggcatcctttgtagtcgtagtactgaccataatgaccgttgcacggattctttctttttgaagctgctctaataaagctagtccatccatccgcggcatattaacatccaacaccacgccgtcatatctttttgcccttaatttttcaagtgcatccagaccgtctctgcaggtatcgattgcctgaaatgtttcatctgaattaataatatcacagatcacccttctcatgagtgcagagtcatcaacaaccagaatattttttttcatttttttatcctctcactgctattctgctgacgcattcttctctcttcttcgaagatgtaacggataatttcttcccttacccgatcattcttgatactgaattttgcacgcgacataaacctgtattctgccgctgattctattttacttgtttcaatcacatttgcaacaatataatactgattatccattgtctggcttttcagtctcagctctgccagaatccaggaatccggtttctgttcctgttctgttgtaaaacggattcctccgccacttaaatccatgatttttccttttcgttctttttcataaaaatgttcatcacggatttccgaaaaaatagcatccacactgtcaagcatggcctgttctgctgtcagttcataatatttaaaatccagaagacacggatatctgaaatattctcttcgctgaaacttttccggctgagatttcaattccatctcaagcatatatatattatcttttttataccgctccttaacctggccaactgtccgatacaatgactcgcgtgagaaaaatacaagttcataacgaactccaagctgtaacagcaccagtttgccagcctccatcggcatggctatttccatatttccattcgagcggaaatcaagcaccttacttttatatgttttcactgtgacgtccgttttttctgcctgttcaacttcctgaagaacacggatatctatcttatcgccgatacgtataatgtctgaaaccttcatatccattcctccttagtatttctgttgccaaaaatttgaaaacattctggcaatccccaaccgtttatccggtaatttttcttcctgtaaaatcagatttgaagccataacttcaaacgctcttgccgacttcgccaacggtgcattcaacgaaacaggtttctgctgtcttaccgaacgttcgagcatgtgatcctgcgggatcattccaagataatttacagaaccatccagaaactgttctaccacagaattcagtttttcatatacctgctgcccttcttcactggatatcacccggtttgacacaatccggatatctgtctgttcgcgtgaaaataaaggattatgatacaatgctttcaataatgaataggaatctgtcaaagaactcggttccggcgtcgtaacaacaagtacttccggacttgccattacaaattccataacctggtttgaaattcctgcccctgtatcaatcaggatcacatctgcataccgatctaattcagccagaccgcgaaccagatatctgatctgttcatccgcaagctggttcatactcaagattcctgctccgccagagataaaccctattcccataggaccttctgttataatctccgtcatgctttttccctggaacagaaaatctcccagattataacgtggaactgcgccaaacataacttcaacattggcaagaccaaaatcagcatcaaaaatcaggactttttttcccattttactgatctgcacagcaagatttactgcaacatttgactttccaactccgccttttccactcgtcacggtaatcacgcgtgcatccagtttccggctctgattttttactttaattacatttctgagattttgagcctgatccatatcattatctgcctcccagaagttgttttactattttttgtgtattaaattcctctatgtcatccggtacattttgtccgtttgtcatataggaaagtggtgctcccgaatacatcttgatattgtaaatattaccatacgcttccgtttcatcaagctttgtaaatatcagtttataatcggcaatctccttatagcggtcagcaatttccaaaagatctttatacttggttgttgcactgactaccagatatacctctctttcatatgctgcatccagacctgcaagcatttttttcatatcattgcactgttcatcattcttatgggaaaaacctgccgtatcaacaaaaataagatcatactcactgactctttcgattgcagcattcatttcctctgctgagtatatgatactcattggtgcatctaaaatatttgcatacacacgaagctgttccgtagccgcaatacgataagtatccgccgtcaggaacgcaatcttcattcccatttccagtttgtacttggatgcaatcttagcaatcgtagttgtctttccgacgcccgtcgggcccacaaagaaaataattcttggttttttcccggaaacacaaattgtatccggctgtcccagttttaagatcattttctgatatacatttgacaatatcgcatccacactgcttccactgtgcatgactttctctgcttcgtctaagatctggttgacatatttttcattcacttcattttccagcagcgttctgtaaagcatcttgataaactgcagtccctccggatttacaacctgacgttctttctcttcttcctttacttccttctgtctgctttcttctacggacagttgtttttccagaatattcgaaagattttccagtcttttctctaatccgtcttttgcgtgcagttccggcacattcgtaagatgtcctgacaggatgtcggatgttctgtcatttgaaaattcttttggactgatattttcatccgctgccagattcaatgtttttacagttttcgctgtcagatcagcaacctgtctcggatctacaaaactctctttttcttctcttgcagctgtaacctcaaacacagaactcttccaggctttaaacatacctgtaggtttgatttcctttacattcatcacaaccgcgccttcaccaagctcctgttttgctttttcgattgcctcttcttttgtttttccctgatacttatttatggtcattttacttgtcaccgtccctgctgattatacctactgactgtaattctacattagactcaatttcattgtaggaaactacaatcaggtccttaaaataatcttccgttaattttttaaagtacattcgaacaattggagatgtaatcacaattggtgtttttcccatgttttcgagctttgttacttcattctgtacagaattcataatagcctttgttgtttccggatcaagtgtaagatatgccccctgttctgtctgcttcacagaagccataatttcctgttccaccttcggatcaagtgtaataacactggttgtctcattcgccgggaaatatttgctggaaatggctctctttaaactctggcgcacgtactccgtcagtacatctgtatctcttgttgtcgctgcatgatctgcaagcgtttcaaaaatcgtcaggagatcacggatagaaatcccctcatccagcaggttctgtaacaccttctgaacctcaccaagtccaagcatcttgggaatcagctcgtccaccagtaccggattgctctctttcagattattgacaagattctgcacatcctgtctggtaagcagttctgcgatatgtgaccggattacctctgtcaaatgcgttgcaataattgatggcggatcaacaaccgtatatccaaggctctccgcacgttcacgctggctttccgtaatccagatcgccgggagatggaatgacggttcaaatgtagggatacctgtgatctcttcctccacatatcccggattcattgccatatagtgatcaaaaaggatctctccttctgtcacctgcacccctttgatcttaatgatatactgattcggatttaactgaatattatccctcaaacgtatgataggtactatagtaccaagttcaagagcaatctgccttcgtatcataacaacacgatccaggagatctcctccctgatttacatctgctaacggaatgataccatatccaaattcaagttctatcggatcaacctgaagcagcgacaccacattctctggttttcgtacctcttctgcttccgtttcctccgcattgacctcttcttctatactctcaataccgatatttttgtcgacctgtcgtcctgcaataataaaagttgcaccaaacgcaagaaacaataaggtatttaacggtgttgcaattcctaaaaccgccagcgtagtacctacaatataaagtactttgggaataccaaataactgactgacaaggatattggaaaaatccgcttctttcgacgcttttgtaacaagaatgccggttgcaagtgagatcagaagggacggtatctgggaagaaagtccatcaccaatcgttagcacaccgtaatgttcgattgcctcctgaaacgtcattccgccccgcagtatacccataatggttccacccgcaaggtttacaaacgtgataataagaccagctgctgcatctccctttacatacttggtagcaccatccatggaaccaaagaacgcagattcttcctgaatcttatttctccgctcccttgcctgtttttccgtgatcgctccggtatttaaatccgcatcaatcgccatctgcttaccaggcatcgcatcaagtgtaaatctcgccgttacctcagcgacacgctcggaacctttattgataacaacaaactggataataaccagaataatgaatacgatggcaccaacgatcagatctccaccaccgacgaactgtccaaatgtctgtacgacattacccggattaccggttgttaagatcagtcgtgttgaagacacgttcagagaaattcgaaagattgtcgtaaacaaaagtaaagtcggaaaaaaagacatatccagtacttcttttacaaacaatgtattaaaaagaacaatcaatgcgattgaaatgttcagtgccagcataacgtcgagtaaattggaactgattggcactataaaaaagatgactgcagccagtagatacagtgcaacacctatgtcagctttcttcatgacctctcctccctgtttctcagattatataccatagcaagaatttccgctactgcctgatacaattccggcggtatttctgcccctatatctacattcgcatataacattcttgccaacggtttattttcaacaatttcaatgtggttttcctttgctttttcacgaattttctgtgcaagataatcttctccttttgcaataacgatcggagctcttgacacctcggcatcatatttgattgcaactgccaggtgtgtcgggttcgtaataaccacatctgcctttggtacatcctgcatcatacgcctttgagaagcttctctcatacgttgtctctgtcttcctttgatctcaggatttccctcagtatttttatactcatcctttaattcctgcttggtcatcttcatatcttcattgaaacgatgtttctgataaacaaaatctgcaattccgaccaccagataaacaaggctgattttaaaacctgcattaatgataacattcccgcataatacaactgcctgattcagcggtatgtcatataaaataaaaatatcatttgcctcaccctttatggatgtataagcaacatatatgatcaaacctatttttaaaatagatttaagcagctcaaataatgaatcttttgaaaaaatacgtttaaatccattgatcggattaaatttatcccccttaggttttaacggcttagccgtgactttccaccctacctgaaggatacttacaagggctgtcactgcaacaccaaacacaaaaaacggggcagccatcttgaacatttctatatacacattatgtaaaaacgaagtaatctcctttgtagatgattccatcgcattaacacttacaaaatcaggcatcagcttatatacataataaaaaacttccaaaaagccattgccaattaacgaaataaaaaccttcaacacgaggaacaatactatcagatcaaatgctgcggtaagttccttactctttgcaaccttaccatcctctcgtgcttctcttaacttcttttctgttgccggctctgttttttcccctccgggtccatcttttgcgaaccactgaaggtcatatgcaaatagtaatctgtctttccattccaccttagtacattccctctataaataaaaccatcatctttttcatttcggtaaatataaaactggcgattccaggcaaaagtgaaattgtaagaaataaaactccaaaaccaaccagtattttcatctgcataccaactgcaaacatattcatctgtggtgcaacctttgccagaataccaagaatacagtttaaaatcatcatacaggcaaatattggaagaaagatcctgaaacctattacaaacagatctgtcatatactgtgttatagaacccgcaagtgaatcccagttaaagatctgaccattgattgggactacggtaaaagaatctaccacagcctgtaaaatcacatgatgcatatctgttgcaatcaaaagaagaagtataaaataattgtacaggtttccggtaattgttacctgcgtattcattgtcgggtcaaattcagtcaccatggataatccaatatccatatcaataatatttcccgcaaataaaataatggaattacaaatgtttgcagcaaaccctatcagcaaccctgtaattccttcttttaacactattatcgcatacccaatcaaacctgtatactcgattgctgtcttatcaacaaaaccatacaccagaagtgcaacaaaaaaagaaaaacctatctttgcctgcgagggcgcattttttgttccaaaaaaaggtgcaatatagacaaaacaggatatgcgaaccaatattaatatcagtatttcaaaattagccaatgaaaacgtatattctaacatagatcgtcctaaccgagatacatactaaaattcgaccataatgtcgtcacgaattctgtcagatttgtcaaaatccatgatccaaaaatcataagtccgacaaatactgcaataattttaggaacaaacgtcagcgtctgctcctgaatagatgtaaccgtctggaaaatactgacaatcaaaccaacaaccagtgaaatgatcaacattggagccgaacagattataatcgtataaattgcttcttttgctacatcaagtacctgtccttctgtcattttgttctcacctctttgctatctatatacattttaatctgtatctataacagaatgtacattctttgaacattctgttatcatcaataaaatgtctttactacgcttcctattacaagattccatccatccgccagtataaacagtaatattttaaacggcaaagagattgttgtcggtggaagcatcatcatacccatcgacataagcacggatgcaactaccatatcaattacaataaacgggatatatataacaaatcccataatgaacgcctgtctcagttctccgattataaatgatggaatcataattgtcatcggaatcgcatcatatgcactctgcccggattcctcatattccttttccagtgcagcactgtcaatatcataactgtcaccagccatatccacgaaaagcttgacatcctttcgctgtacctgtccatacataaactggcgaatcggcacttccgcttcttttaatgcctcttctatggtaatatctccattatccagtggctggattgcattctcattgatctgctgaaacgtcggccacatgataaaaaatgtcaaaaacaatgccagtccaatcaaaatctggtttggcggtgccgtctgtgttccaattgccgttcttaaaaaatgaagtacaattacaattctggtatacgatgtaagcataatcaaaagcgatggtgacactgcaataattgtcaataacaataatgcacgtacttctgaagcaacccccgcctcatcattatttatcgagatggacagaccacctttgctgtctgactcactacctgaacctgtgctggtattcgctgctgtattatccagcgaatcaatgctgtctggatccatggaagctgcataaacagtcgttctgttttgtgaggcaaacaacactgccacaaacactgctattgcaaatattaatgacagtatacaatatgtcttttttaattttgtcataattccatcaatcctgctttttcggaaaatgatctttcagtctactaaatatctcctgaaaattttcctgtgaatttttcatatcatccgatgtctggactgataactgatcttctgtaagttccgcaatttttgttacttcatccttacccacagcgattacaaaatactgttctcctgccttaacaagctgtaaaaatttaccatttgcaatccggattgtttcgagaaccttaagatttcctttggacatttgtattttttgaaaaccacctacccactttgtcgtgaagtaggtaataatcaaaacaaacacaaatatgatcagtactccaatcagctgcatcagacttcgaaaagaagcgcttaataaaatcatactaacccactactttttttactgcctcaagtacacgctcagcctggaatggcttcacaataaaatcctttgctcctgactgaattgcttcaataaccatagcctgctgtcccattgcagaacacatgataacatttgcatttgcatcaatctctttgatcttctttaatgcctggataccatccatatccggcatagtaatatccattaataccagatccggttttgcttcaggatatttctccactgcaatagcaccattttcagcctccgctgcaatctcataaccattctttgtaagaatgtccttaatcatcattctcataaatgcagcatcatcacaaatcataaccttagccataattttctctcctatctttaactcttcttttttgttttttattttataatttcagtaattcgtataccatagctttcttctattactactacctcgcctttggctacgaatttaccatttaccagaacatcaatcggttctccggcaatcctgtttaattctataatggttcccggtgtaaaatcaagtatttctttaattgatttggaagttcttccaagttctaccgtaacttcaagtggtacatccataatcaaatcaatattttccggttgaaaattccccggtactgctccagtaaatgcctggaattgtgccggctgtacatttacctgctgttgtccatacatctgcgacatctcctgacccatcattgattgtcccatcatcggctgacccatcattggctgccccatcatcggctgtcccatcattggctgctgtgctgccatctgaggttgtggctgcggtgcaggtgtcggctgagctgccggtgtactctgggtgttctctttttcactcattcctgcagtggaattactgtcttcttccatattgcttgttacatttgcacacatttcttttgcaaaagaaacaggatataactgcatgatctcactatcaacaagatcaccaatctctaaccggaatgaaatttttacaaattcacctgcaaggaactcatcaatctgactctcatcaattgtctgttgcaaatctatcagatctgcacttggcgggctgatatcaattaccttgtccagcatggaagacaatgatgttgctgccgagcccatcatctggttcattgcctcgctgattgcactcaggtgaagttctccaagttctccatccgtatttgttccatcaccgcccatcatcaggtccgtgataacttttacatcatgttcctttaacacaaggatattgcttccatctaatcccacggtatacgcaattcgtataaatacacatggcttttcatatgcgtcacatatatcactccagtttgcaaacgcaaccactggggtggaaatctcaaccttacggtttaccagtgaaaacagtgtagttgccgctgttcccatactgatattcgagatctcaccgatcgcatctttttcctgttctgtcaatgtattttccggattttcatctgtacctgaaggattgttcagtaaagcattgatttcttcctgtgacatcgttccatccatcttactgctcctccctaatcactgatgtaattcttactgcatagtcatcaccggtttctcccggcagagcagtaaatttttttatacttccaacaaagacactcagttcctgatcaaccttcgtatccagccggataatatctcctacctgcagtcccaaaaaatcatttactgaaatggaactgttaccaagtacagctttgatcggcattggtgcttttgaaataagtgcctcgatcgtttctgtatactgttgttcatctttttcctgcagactcgaataccagtatttggtattcagtttgtccataatactctctaaagtcagatatggaaggcatacattcagtaatccctccacatcgccaatcttaacattgagcgttaccagagctatcatctccgtcggcgatataatctgtgcgaactgcgaattcgtctcaatacgctctaaccggggttctaactcacatacattctcccacggctccactaaaagatctactgccacattaaatatccgctcaatgatcagcaattctatctccgagaaatccctcggtttatccagaggcactccctttccacctaacattctgtctactacaacatatccaagattttgtgccatctcaatgacaatgcttccattcaatggagatgcatttacaattccaagtaatacaggattcgataacgcatttgaaaattctgaatatgtaactgcttctgagttcatcacctcaacctgaacatttttccgtaaataaacaggaagattggttgacaagagtcttccgtaatgttcaaagataatctccagcgttcgcagatgttcctttgaaaactttgcaggacgggcaaaatcataatttttgacctgttttttatcttcatctttcatttcatctacatcaagttcaccactgcttaacgctttgagcaaactatctatctcattttgagataagacttcacccattctttctcaccacctaacacaatatttgggtctattccgtctgaacgcttgagaagtttacaccaacgatgaagtctgaacctccaaacatatcctgtaatgttttcaatatatcatcttttacattctgatagccatttgcattaaactcatccaatgtatatccatttacaatggtattaatctcgctctgaatgatcgtcacttttgcagcaagtccttcggatccaccataggttttgtatccgtcactctttgtattcaaagataaactgactgaaaatacagcatagtgttgtttgccatcttcgccctgttttaagttcacggtaaatccatcggtgatcgcataagtctcaacatcttcgatcggcacctccggtgtagccggcgtattttctccactctgaagttccagattaatagcagagcatacctgatcgatcagctgattcgatttttttgtctgcggaataatcgtgaacacaagaattgcagttaaaataagatttgctaaaaccagtgccagaataattacggttatcaaattctttttcataatgctaccttcctgttcaattaaaatctgaactataagaattatatatttttataataacgcggcggtttcttgatcttccctcctgcgttgtattatctgcaacaggtacatactcacctcttccagatgccttcaaatgtgcgggctccactgttgtaatatctctcagataatctgtaaccgcccgtgccctgtaaaatgaaagcacatcattatcttcatattttgcagaatgaatcggcacgttatccgtgtgtccctctacttctatgatattatcctgataaggttcgatcagcttacccagcttatcaatcagcggatacgcctctgatcggatttcagcatgcccggagtcaaacaaaagagctccattcatattgagcatgacatactgtgcattgaaatcaacttccacctgatcctggattccatatcttgcaatggcatcctccagctgttcagacattttttctgattcttccagtgcctgttctttatattcttccactacatcattctcttcgtctgtttcctgatccgtttcagagttcgctttgtctttataataagaatctaacatttcaagctggctcacaccggatgatatcagagttccatctccaatagaagatcctccattgggaagaatactaaatgtattctgaaaggaagccaccattttttcaaacttttctgcatctaccgttgacatagagaataacaatacaaagaaacataacagtaggttcatcagatctgcaaatgtattcatccatgccggtgatccttttggttcatcaggctttcttttcactattcttcacctccagcctcgctttcctgcgctgtattacgcgccgaaggtgcaaggaatgatttcagtttttcttctataacacgtggattttctcctgcctggatcgacagaataccttccacggaaatttccttcatcatcatttcattatcattattcagttttaacttacctgcaatcgggttacataaccagtttgcaagtaatgaaccatacaatgttgtaacaagcgccgttgccatcgccggtccgattgtagatgcatcttccatgttcttcaacatgaggatcaatccaatcagtgtaccgatcataccccaggcaggacctaattcagcccatttctcccagacagcaattttagctttatgtctgctctcaacgcaggctaagtcagtctccatgattcctcttaccagttccggatctgtaccatctacaacaagcataattccttttttcagaaaatcatcttcaatcccgtttgctgcttcttccaatgccagaagtccttcttttctcgcagtattcgacagtgagataatctggttgatgacaactgccggatcctgaacctcatccttaaaaatcagctttattgactttacaccattgataaaatctgccaatttaaaagatgcgagcgtacctgcaatggaacctcctattgtaataatgaatgatgccgtatcccacatggagtgtaaacttgcaacacctccgttggaaagtacaccaaacacaaacattacaacgcctaataacatacctactattgatgctatatccactttttccacctaccatccttgatttttcagattataaaatcccatccgtgggacttattcttctcttaaaaggccatttgtaaaaatatcccttttgtatgattttactaaatttttgacctcttgtctactttcttttacaataaactttttacctgttgtaagagaaataactgtatccggggtctcctccaccgtttcaatcagatccgaattgattaatactgttgttccattcaatcgtgtcacttcgatcataaagtaatcattcctccattattaatcaacagtttttattgtgaccgattttttcaaaaaccggtcacaatgttcagtataacatatgtaactgattgtgtaaaacctgtttcaacattttaagacaggttttacgcaaatattatcttttcttactttacattaacgtttcagattaaccagttcctctaagagggtatctgatgttgtgatgatacgggagtttgcctggaaaccacgctgtgtgatgatcatctgtgtgaactccgtggacaagtctacgttagacatttcaagttctccggatgtcatggaacttccgtccgcagaaatctcaacaccaattccatcaaattcacctgagtttaaggttgtacggtaacagttctctcccactttttcaagaccggatgcatttgcaaactgtgcaacagcgatctgtccaagtgtctctgtattaccattatcataggtacctgtgataagaccattgttatcgatggaaataccgatcatggcacctaatttctttcctttgcctgtcacaccatcatctatagatcctgtagacataactgctgtggatttaccaccgttgtctgcatcttttaagccggaaaagtcaatggtaatgttttcaaactgcgtcggatcatttccaagtttgctcatattaagtattacactagttggattgcttcctgcgtttgctcttgggccaacgccttcaaatgtaccatcttttgtactgaaatcaatttcataatcagttacatctccggtaattgtcagcttgccagtctttaaatctacagcaggagttgctcctccatttatcttgtcaaccattgcatctgaaataccatacacctgttttaaagaatacgtttttgttccatcctccgaagtaaactccttattgttttcatcccaattaattttagttcctttattatcatttccgacgtaaaattgtccaccatttgaactgtcatgaaaatatccactctgcacactgtcgtagcttccaagtgtggcattgtttgttaacgatccgaaaatattatcaaccgaaatagtcttattgtctgttccagttccttttccagttgctgcatcatagaacgttgttccatcactatttaaaatcttttccagctctaccgtatattttccatctgttcccatagatttcattgcaaaacgcgctgtataggaataaccaagattatcaaaaaatgtcagtgttttgacaagtccgttgtctgacaatacatccttatcatttttatcaataataccggaaacatttgcctgtgtggttgcctccggagcagatgtcaggttggatgtctgcatgacacgaagtgcagatacggtatccttcttgatatttcctgttgtcggatctacctgccatcccataactgtataaccggtggatgtcatacataagttaccggcaccatctacatagaaagaaccggctctggtaaacaggttctcagaaccgttgttaactacaaaaaagtttgtcgtagactggtctgataaacggatatcgaatgcacgtccggttgtttcagccgcaccggaagttgtgatgcttaagtttgttgcaccggtcgtaacaccaagaccgatctgttttgcattcacaccaccggtacctgttgctgcgttcgcaccggatgcattacttgtcatctgatataaaacatcctgaaatacaactgaggatgatttaaaagctactgtgtttacgttggcgatattgttaccaataacgtccatttttgtctgatgtgtcttaagacctgacacagcagagtacattgatctcatcatagttgaaattgacctcctaagttcttttgtgctgctttcccttctgtcattccgggaatctagcctccatttcggtccggctacatgatcacagcaccatcaatattggtataaatattatcatcggactctgtccggtccattgctgtaacgactgtcctgttcggaacatttacgataaaagcgagtgaatcaacaattactaacgattctctgattcccttttcaccagccttaaaaacgcctgtctcaagtcgttcattctgctctttggacaaattgatattacgatccatcaggcgcatcgtggcatgcttggaaaatttaagtgtcccacctgcttttgcatcctgcttctgctttaaaatatcttcaaaggagacaccactcgaagttaccgcatccgtgcttttccgagtcagatactggtcagttacctgctcaatggaagcaaactggttactgatcttattcataatcgcatttcccttctgtcagatatcaggttttatctgtacctgtcgttgtgtctgtatccgtttttgtatctgttcctgttgtcgtatctgttgttgtacctgtcgatgatgaagtacttttataccagtcttttcctgcaagtttttccatctgtgcaagcagttcctgatattttttcaaagtatctgtatcgatctttgactgctgataagaattcagattatcataatatgtctttaaattcttgacatcatccttgtcacttaatgtaagctgtgctgcggatggcaatttagcaaccgctgctgcaaacgtcttagcaagtgtctctgcctccatgtattcggtatctgcaacctgatatacatcagaaagtgaatataacaccccatttacacagatcttctgctcaccgttttctttctgtacataatcaacaaatccctctgttgctgttgtttctccagtcgaagatgttgtcttgataataacatattttccaacaagtgcatttgcattgctgctctcgattgtactctgcataccaagtgttgcttccatctgtgaaaatgtagcaagctgtgcaacatactccgtattgctggtaggctctaacggatcctgatactgcatctctgcacataacagctgtaagaactggtcatagccaaggtcattgctggtatccgatttgcttgtagtactggtatcctttggtatttttccgtctacaacgggctgaattaatgccatttttttctcctttcttttgttttaagcagtataatctacggaattaccgtgatctgccataatctgcgccacaagggcttcttcctcactcatgactccggagagttcatctaactcatctaagttgattcttctagtctttggcgaagctttttcctgctcctctgcctgtctctcttcctgttttgcattctgctctaagtttttttcaaactcatggcttccaaccgtaacttctacggcatccaccttcacacctgcctggttcatactctgtttgagttctgccatctgcgcttctaacgcttcttttaccagttcgttctgtgtcataatatgagcagatacatttccttccttggtcgttacttcgatataaatcttgccaaggtgttccgggttcaactgcatctccatcgtcgtctgtgcttcacggacagtgatttttgtaaattctgttacctgacggatcagatctaaagtgtcaagctgtcttgaaaattccggcacattttccggtgtttttactgctgccggatctgccacatgttcctgattcacaaatgctgtctgacccgatgcattcccagattcatttttactgcctgtctgctgtcccttatctgactctgtctttacatccggttcttctgttttctccggcatcagaccatcattcacgtcatcggtatccttcacattatctgcgacttctttctgcagaacaatgttgtcctccggcttctgtgtttccacttcatctgcatttaaaactgtctgtactgttttatcatcttttgcatctgaaatcatctgctccggcacagcatctgctgccgtctgtactgcgttgtcattttccggcacctgaatatccgccgataactgctctgcattcacatttgtgtctgttgcagcagccatctcagtaaacatctgcggtgtcattccaagttcatctaacaggttctgtgacaactctccaatttcatttacaatttccataaatgaactgttgcacagcagttctccaacattttcacatcctgtgagttcagctgtaagctgcgcaagctgattcggctgtatcagatctgcaacagtaagtcctaacttctgcatggcatctgcgatttcttcatctgtcacaccaagtttatctttcaaaacctgtctcacatcctcatcaaatgcagctaacttttcatccgcattttctgattgaatgtccgttttgcctgctgaattatcttttatactgcccgcagcattctgataacgttcataatcatctgccacactactgtttccggttacagctgccacatcctgtctgctgttctgtccaccataattgtaaccgcctccaacctgggttgtcatctggctcatcacttctgcaaactgaactttcagatcgccttcttttgttccggtcagtgtctggccgccctgtcctatggacataattccagccacttctgaaacgcgcgtgcttcccatgtttcttcctcctttccctttcgctgcatgtactgccgcttaatgatctattctgaaggtttcatgatctctgttacctttgcagcggtatcagaagtcattttaccaagaatagcagctcttgaatctgcatccataccatctaaaatctgtgcaaccagtttcaggttgtctgtcatggtatcaaaaattgctgctgcctcttttggcttcatggatgaatatgttttgatgtaatcatcaagctgctcatcctctgccgtctgtgccactacctgcttatacagtacttctgcatttgcaggatcgatgctttcgtaatatttcttatattcctcaatatccggggctacatcagaaaagacaacatcctcatagaagctctgcttttccttttcaaattctgcctcgttttccttatattgctgtaattcctgtgattgagcttctaactggctgatataatccgcatttgcagacgatgcattctgtgcatctgccagttctttttcaagttctttaatgcgctcaaccgcatctgccatcgtatcatacgcataagcactgtcctctgttgaaacctgctccaccgcatcatccggtaaaatcttatttacataagggacatctttcaggatcggtgcaagcacgcctgatccaaatcctccaacatcccatttaatcagaagggcaataattgcaaaccatacaactatgatcagaagggaaacaaaaaataccgcaactttgctgccgccgctttcttcttcaagttcatcgctctctgctgcatgctgtgctttcttctgctttgcctcttctttttttctttgtttttcttcagcttttttatctacaacttcttctttttcttctgccatattttcctcctgtccgctcaaactgcctaactacgctgtccattatcgtgataggtataactgacaagctcatctatttcttttgactcttcatgtaaaagttcctgtttaaactcctcaaaagctttttctttcagtttttcatgtgtcttgcgttcaaccattgcttcattcaactgttttctcgccaattcaacatcacgttctgcagcatgtacattcatcatctggctgcgctgtttgctttttaagacgtcaatcgccttcctgcattcacgaatttccaaaacattaatactgccactcaccaattctcttgcttttgattcataaccggctctccggatcaggatatcctgaagtttctgctgttctgccgcaagttttgcattcgccataccataggctgtctttgcctgattttccattttttctttgatatcaagaatgttctgcattctgtatctgaactttgccataccagaaacctttcttagttttcaaacagttttcgcagcaggtcaatctcttcgttgaattcaaatttttcatcggtcttttgcatcaggaactcatttaccgcttgaattttttgaattgcataatcaatttcacgattggttccatttttatatgccccgatattaatcaggtcttctgcctcattataagtagccataacatttcttaattttccggcaagctctttatgctcacttgtagcaatcgaactcataacacgggaaatactctgtaatacatcaattgcaggataatgattcttttgtcctaattttctggacaacataatatgtccatccagaatacttctcgccgtatctgtgattggttcattcatatcatcaccatctacaagcacggtgtaaagtccggtaatagatcccttatccgaagttcctgcacgttccagaagtttaggcatttctgaatacacacttggtggatatcctcttgttaccggtggctctccggatgccaacccaatctcccgctgtgccatagaaaatcgtgtcagtgaatccatcatcagcaacacatctttcccctgatctctaaagtattcagcaatagctgttgctgtttttgcagctttatttcttatcaatgcaggtttatcggatgtcgcaacaataaccacggagcgtttcatgccttcttcaccaagatcgcgttccacaaactctcttacttctcttccacgctcgccaatcaatgcaatcacgttgatatccgcttttgtatttctcgcaaacataccaagtaatgtactttttccaacaccggatccggcgaaaataccgattctctgtccttttcctactgtaatcagaccatctactgctttcacacccaaaggtagtacttcatcaataatttttcttgccatcggatctggtggcaatgcttcaaccggataatcatacggaagtaataattcttccacatcggttggccgtcctattccatctaatgtatgacctaacagttcttctccaactttcacagtcagaggatgtcctgtattttctacaatacatccaacaccaattccttctacgctttcaaacggcatcaggagtaaatgtttatcacggaaaccgacgacttcagccatcgttgaaatattttgttcccgatcgataatgatacggcacagatcattcagttttgcatttggtcctacagattcaattgtaagaccgacaatctttgtcaccttgcctaaacggttaaaatacgtcttatcggcaagctgaagatatttatcaaatgtacccattctgccgcctcacctctatgagcataatgctttgatatccttcatcagattatcaagctgtacgtctacaccacagtcaaatattcctgcgtcagtctctatggtgcacgcattttcattcagtgtataatcaggaacaatttcaagttctatgtcatgtccgacataatctaatatttcatctttatgcttttctaaaaatgacacattgtctcctgcaaccttaatccggaaatgcttttcatcttcgatatttgcgatagcattatcgatcagatgaagcaggatttctttcttatcatcaaactggatatgaaaaaccttattaaaaacatttaatatcacatctaccagttctttttccatgtttttttgtttttcctgataagaattctgcaactgtatttttttctgctgttgttcctgttctaactgctgttttttctggttatactcctgttctaatgtattctgtccttccagataaccctgtttttttgcttcatcacggatagcttccgcttcctgtcttgcatcatcaatcagcacatctgcctgtgctcttgcctgcgaaagtatctgctccgctttttcattcacagcagtcatatcctgttccggttcttctacagggattacattctctgttttgtcagtaataatcccctccgcaaatccatccggtcctacaggccggtcttgttttaccatctgttgtttcaggaactcctgtatatgatcatttgaatcgatcacccttgtattctgactctctgtatgcacgaaccacggtttataaagattagacaacgatctcgtcacctccgcctctggagattacaatctctccagaatcctctaatttacgaatgacactgacaactttctgctgagcctcctcaacatctttcatacggacaggtcccataaactccatatcctctttgatcattgcagccagtcgttttgaaagattcttaaagataacgttctgtacttcttcgtttgcagcctttaaggcaactccaaggtcagcattatcgacatcacgaagcactctctggattgcacggtcgtcaagcagcagaatatcttcgaatacgaacatcttcttgcggatctcgtctgccaactctggttcttcgatctccaaagactccataatatgtttttctgtcgtacggtctaccgtatttaaaatgtttacgatggcatccacaccgccaacaatggtgtaatcctggttgacaagggaagaaagtttcttttccagcacacgttccacctctttgatcacatccggagatgtacgatccatcattgcaatacgttttgcaacatctgcctgtttttccggcggaagtgctccaatcacaagtgcagcctgggctgatgtcagatacgacaagatcattgcgattgtctgtggatgttcatcctgaataaagttcaataactggcttggatctgtttttcgaacaaattcaaatggacgtacctgcagggacgctgtaagttttgtgataacttcctttgccctgtcctcaccaagagccttatccagcagctcttttgcatatccaataccgccttctgcaatatactgctgtgcaaggcagatctgataaaattcatttaaaacatcttccttaacctgtggtgaaacacttctggtgttcgcgatctcaagtgtcagttcttcaatttcatcttcttttaaatgcttaaagatatctgcagaccgctccggtcccaaagcaatcaaaaggattgctgccttttgtattccagtataatcttgtgtgttcgttgccataccttattcccactcctcgttcagccagttgcgtaataatgaagctgccgcttccggattgtcttccacaaatttttcaatcaggatacgggtttcagatttttcattgtatccgatatcctgcatttcttcctggctttcttttgttgattcaagcagactttcaacagaaagttccggctcgatctctgccactttttcttttctggtactgcggaacaccacataacccaaaagaagaaggatcagtaccacaagtacaatctgtaaataatcagaagcacttcttccaccggaagaatactggaaaaccggttcctcctgtgcaatgatggtaatcttatctgtcgggattcctgttgcattcgaaatcatcgtgatatattccggatcgacagtaatcgctgtcgggtcactgtttgccgcaacatattcgtcgaacgtcatgttgtcaagtgctccggatgcacgcagtgtatcttcatcgtaaatgcggtatttcgttgctaccagagaaacggaagagtctgcataattaacagttccgccatttgatgactttttcgttaccttttcattgttctggtagtttgtggttgtatctgtaacagtactgtgtgtgtaattgttatcttcaatcacataagacgtatcatcattcgaatctgttccaggtgttgcagctgcaccaccttctgattctgattcgtattcactcttactgccaaccataccattcgtctgtccgtccggtgcataatattcatgcgttgcttcttctgacgtatcgaaatccatcacaagttccggtgccacttccacatggtcaaacaaagaagaacccaccataacatctttcactttactctttaccaggttttctgcttttgattttacagagagctggctgtttgcagttcccacattggtatcagaagagtctcctgagaataagacattcgaattagaatctaaaatctgaatattatctgtatttttatttccaagctgtgttgctatgtattttgcaagacctgctgcctgatcctcatccatatctccgtttaaagtaagaatcactgctgcataggaatcctgatcttttgcaagaattgttccatcatcatttggaatatcgagtgttacagaagcactttcaacatttgacagggtttccaactgttcagcaaaatatttctgcagataaactttgtatttctttgtcttgtctgcctctgttgaactgaatccgccatcaaaaacattatcaatggatgcgccctggctcggtatatcattttttccgagcagaatcgaagcagccgcctcatcttttgcatctacataaaagatcagtccatcctgagacatctgataagaaatgctctcgccatccagaagatccttcactgtacctgcctctgctgttgtctgacactcgtgcagtgtaaccatattgggtttactgacaaccgctgccagtattgccagcgcaacaatgatcactgcgacaatgctgatcaataacgctttctgctttgtattaaactttttccaccattctgtaatcttatttaatatattttgcacctgttccggcatgttatctgactccattcattaaatttgcatattcatgatttctttatatgcatccagcattttatcccttaccgctgttgtatactgaagtgctgtaagtgctttctttgccgcaatctgcatatcatgcggattatctgcctttccaagggcaaattctatctgggccgcttctgcatcattctgtaaatcgctcgtttctgacaatacattcatcgccgaatcaagcaccgactgaaagctgtcatccgaagtatttacaagtctgttctgttccgccaccttttcaatataatctgatgtgatccctgttaatgaagtaatatccatttaccgtcattcctttccttacttactgatattcagtgcagcctgcaccatacttttcgtcgcgtcaaatgctgttgtatttgcttcatatgctcttgttgcatcaatcaggtttgtcatttcagttaccgtattcacattcgggtatgtaacatatccattttcgtctgcatccggatgagacggatcataaaccatacgcatctctgtctcatcatcctcttttacagatgtcaccttcacgccatttccaaccgctctcgctcttgcagtctcataatactgtgaaaaaggtgtttctgtcttttctgcaaatgtaacgatctttctccgatatggtgtaccgtcttccgtcctcgttgtatttatatttgcaatattctgtgcgatcgtgtccatacgaaagcgttctgctgtcattccacttgcgctgatatcaaatgcctgaaataatcccatatactttccatcctttgttctattttcaatcttttatccgtggcagtcaaatgttcgtaaaagtatgtattctattactttagaaccgtctgcattctcgaaaaattatttgttatcgccgttgtcaaaagctgatatctcagtgattcagaagccagctccgcattttctgtgttttcatccacattattgcggtcaagtcgataagaataatttgccgcatctgtataagatgtcgttgtaagtttccccagatcctgattcagttccctcacctttttatcaaggctgctgtattttgtcttgccaagtgctttctgcaatacggactcaaagtcaacatcctgtctcttgtatccaggtgtgtctatatttgcaatattattggttatcacattctcacgcatccagcttgcatcagccgctttatcaagtatatttgtatagtcaaatacatttgttgtaaacatactgttgctcctttcatgcactattttctatattattctattttattataaaatatctcaaaaaaaacacaagagttttttattttttttcgtagttttttcccgtattttgtattattttatgatttggtgtactacaatttgtccttatctttcatatttctctctttttcgacattttccgcgtttttgcgcgcatcttcttcagatgaaacaccagcgtttccgcaaaaacatccccgaaaatgaaaatttttcaagaagatttttatcttatcattcgatttttcaaatttagggatatgaaacagcaggtttcatacaacgaatggcattcatctgtattctttccactttcaggtgtacgactcaaaaaggaatccgctatgtttaacaaataacataacaaattcctttttgttttaactattcttatgattctctttctttattttgtccagttcatcaaacacaacatcatttaatactttgatgtatgttcctttcattcccgaagatcttgattcgatcacacctgcactttcaaatttccgtagtgcatttacgattacagatcttgtaatcccaacacggtctgcaatcttgctcgcaacaaggatcccttccttgccatccatctcatcaaaaatatgtgtgattgcctctaattctgaaaaagacaatgtactgatcgcagattttacaatctgtacttttcttgtctcttctgcattttcttcatttacagaacgcatcatttcaagtccgaccaccgttgttccatattcactcagtataatgtcatctatatcatattgacggttctcgcgatatacaaataatgttcccagtcgttctcccgcaatatcaatcggtgtgatgattgctgtatatttttttacatcatccacaaatccaagtgtttcaagattcacattttcttttgtggacaggattccaagcaaacgttcatttaaaagcgggtcgataaaacctcctacctcgtccacaatcaattcattgatctcttccacaccctgaagtactcctgttccaagtacttttccttttttactgatgaccaggatatttgattccagtatttcttttaatacatcacatatatcattaaataccactttggaagaattattattgtgaagcaatttattgatttttcttgttttatctaacaactgaacactcataatacgtgcctcctgactacatatatgtctttcatgatatcttatattttatcacgttaattctgaaaattcaatattctaatatattttccataaaattatttcattattcggaatctttttcaacatttttacgatctgtcacataaccgcattgttcatctgcacatacaattttgtttcctttaatcaccatataaccgccacattttggacatttctctgcaacaggccttgaccagctcataaaatcgcattctggattatcctcacacccgaaatattttctgccttttttcgttttgcggagtacaacctccttgccgcatttcggacatgtaaccccgattttttcaagataaggttttgtattccggcattccggaaatcccgggcacgcaaggaatttaccatgcggcccatattttactaccatgttcctgccacagacatcacagataacatctgtcacttcatcttctatttttactttttccagatctttctgtgccgcttttaccgcctcatccagatccggatagaaattacgcaccactgttttccagtttacattgccttcctcaactccatccagcagcgattccatatttgcagtaaaatgttcatctacaatacttggaaatgattctttcataatctgatttaccacttctccaagttctgtcacatataaatttttcgcttccttgacaatataacgtctgccgagcaatgttgtgatggtaggagaataggtactaggacgtccaattcccagttcctccaatgtttttaccagagatgcctctgtataatgtgccggcggctgtgtaaaatgctgtttttcatcaaactcttttaaattaagcactgtattctcatcaatagaacctaccagaacattattctctgctttttcatcgtcatcacttgtatacaccgacataaatccgtcaaatgcgattttcgatgcagacactgtaaaccggtattctcctgctccgatctttacgttcgttgtctcgtaaaccgcctgcgccattctgcttgccgtaaaacgtttccagatcaactggtaaaggcggaactgatcacgcgacaatgactcttttaccatgaccggagtacggttaatatcagatgggcggattgcctcatgtgcatcctgtattttggcaccattctttttcgtcgttttttcgcctgcgatatagttttcaccataatttccggcaatatattcccgcgcctgtgcatctgcctcttccgaaatacgaacagaatccgttcttaagtaagtgataagaccaactgttccctgtcctttgacatcaacaccttcgtataactgctgtgcaatccgcatagtctttgaaattgggaaattaagtgccttagatgcttcctgctgcagcgtactggttgtaaatggcaatggggcctttttcacacgttctcctttttttacttctaaaacatgaaactcctctttctgcatctctgccatgatgcggtctgcctgctctttactggaaatcgtaagttttccgttctcatctccataaaattttgcgagcagtgtctttctctctccttttacagataattctgcatccagtgtccagtattcttccgggataaatgcgttaatttcatcctcacggtcacagataatgcgaagtgcaacagactggacacgcccggcgctaagtcctctttttacttttgcccacagtaacggactgatctcatatcctaccagacgatccaggattcttctggtctgctgtgcatccacaagattcatatcaatcttacggggttcttttaaggatgctttcactgcattctgtgtaatctcattaaaagtgattctctgtgcatttttatcgtctaatttcagtgcctggctcagatgccatgaaatcgcctctccctcgcggtcggggtcagttgcaagataaactttatctgctttttttgcttccttgcgcagctttgctaaaatatctccctttccgcgaatcgtaatatattttggttcaaaatcattctctatatcaattcccatctggcttttcggcagatctctcacatgtccgtttgatgctactacctcataattttttcccagaaatttttttattgtctttacctttgcgggcgactccacaataacaagatactttgccatgcatccatctccttttatttctgacaatagaccagtccgccatgcgcacaatccctattgcgtctgacaacaatcctgttcttcttatacggattgtcatatctaacaatttcttttagatttttctgatataataatttttaaccgtctcggtaataaaacctttttgcagaagtctggcaagaatgtccatcatttccggcactgatataccagtcttctttaaaagctccccgacgtttttcggtcgtaaacttagacaactatacaccagtcgctcatctttttcaagtaataaatttttcaaattatcttctccggtatttatctccccctgtaattcgagttcttttaaaaattcatctacgtcagaaatgatcccggcaccctgtcttatcagattgttacacccctcactcaaagcatcatacatacgccccggcaccgcataaatatccttcccctgttctaacgcataatccgctgtaataagcgatccgctttttatttttgcctcaacgatcactaccacatcagcaagacctgcaatgatcctgtttcttgccgggaaaagtggcgcagacggatttgtacccggtggatattctgaaatgatcgcaccatttttttcaagtatctcctgatatattctgctgtttgacttcggataacagatatctgccccgcagcctaacactgcgcatgtatatccgtttttacgcagtgcacctgtatgtccactgccatcaacccctgatgccatgccgcttacaacccacgcgctcgatgcagcaagccttcctgcgatcttctctgccactgagctgccataagcggaacagcggcgtgcccccacgatcgccactgtctttttattccactcctgtggcatagttccttttacatacagactgtacggtgcatccggaatcgcggcaagacgttgcggaaatagctgttcttctctggacaaaaagaaaattcctctttccgccatgctttcgtactctgtatcataatctctttttttactctccataatccctgcagcatgcttttcttccacccctggtatcagaagaagctgtttttctgtcagtccataaatttcccgcgcacttcccgctgcaccgatcagtctgtttctggtgcgtattccaattcccggtatattagaaagccagtatgcataattgatcaatccatcccctcccagaattttttatcaatatttctgtagcaaagcgcctcgtttaaatggctcatttttatctgttcgctttcatccatatccgccagtgtacgcgccacacgcagtatcttatgataggtgcgggcagtcagatttaatttgtcatacatttgttccatgtaaatttcctgttttttgtcaagtttacaatattcaaaaatctgcgaagacgggatatgactgttaaagcaaaaattttctccccgataccgcattttttgtatttcctgcgtgcgcacaacacgtgctcggatttcttcggatttttcactttttccggtattgtaaagatcccgaaatctgacctgtggaacttccacacaaatgtcgatccgatccaaaagcggtctgctgaccttccgcagataccggtcaatcgcagccgatgtacaggtacatctttgcatgtccggataatacccgcatttgcagggattcattgctgccacaagcataaaatcagccggatattcataacttgcattcagccttgctatacagatttttttctcctccatcggctgtcttaatatctctaaagtttcccgctgaaattctgtcagttcgtctaaaaacaggattcctttatgcgccagtgaaatttctcccggttttggcaccgcaccacctcctgcaagcccctgcggtgtgatcgtgtgatgcggcgcgcgaaaaggtctttcctgcatcagtccccttttgtgctctaaaagtccgcaaacactgtatatcttagaaagttccatgcgttcttttgtatttaacgaaggtaaaattccagggatccgctctgcgatcattgtttttcctgctcccggaggaccgacaaaaagcaggttatgcattcccgaaacagccgtttcgcaggcacgttttacaagctcctgaccgctcacatccgcaaagtccaatatcctccctgtctgcatttcttctatattatatggagtatcaaaatattctccatttccgtttaagatattcacagcatccgcaagattttttacggcaaatacctgcatgtccgataccaatgccgcctctcctgcatttttccatggaaccatacattttttcattcctctttcttttgcctccgccaccattggcaaaattccatttaccggttgtacttttccattcagtccaacctctcccgctacaaaatattccctgaccatttcctgtctgatatacccgaatgcggtaaggactgccaccgcaaccggaaggtcaaacccggaaccggattttctgatattcgcaggcgtaaaattgatcgtaatatgctttggaggcagggcaaagccgcagtttttcaatgctgtacgcactctctctttggcttcctgcacttccgaagcaagaaatcctaccatttcaaacacaggcagaccatcactcacatctgcttccacagaaatcggtacactctggatcccgtgtatgattgccgttgatacaatactatacaacgtactcctcctttttattcatttttcctctgatttatctgatgatcacagcagaaatgctgcaactgatctgcaccagcatatgccagccggtgcatctgacaactgagcagtctgtgctcagtttcctagactttatacaaatccgaacataaggcggcgacatccgccgtcgcctaagtataacacattcatagtagcaagtacaaccttattcgcaaaaacttttttttaatttatccagcgcctttttttcaatacgcgaaacgtaagaacgcgaaattccaaccgcggaagcaatttccctctgcgtcatcgccttatttccaaataatccgtaccggtgtacaacaatatacagttcccgttcctgcagcactttcggaaccagtccaagcagcttttcaatctgtcttgtacgttccatcatctccacaacatccggctcctcactctctacaatatcaagcagatggatctggtttccctctttatccataccgatcggttcatataatgatacttcacgcgacactttcttttttgcacgaaaatacatcagaagttcattatcgatacacctggctgcataagttgccagcctgctcccgtaatcttccttgtaggttgcgatcgctttcatcagtcctatcgttccgatcgagatcagatcctccatatcttcttctgagttctgatattttttcgcaacatgtgcaaccagccgcatattgtgaagtgtcagttcgtttcttgcttcaaggctacctttttttaattttttcaggcattcgttttcctgctctggcgtaagtggggataagaatgttttcaaaacgcaccttaaaagctttattaatacattctatgttttgaccagggtgtgcgtgcttttccccatttatttttcctaagttttattatataatgtccgtatgattcgacaattcacataccggatagaaccggaatacgactcctttaccattcgggaatacctttcattaaaaggctatcccaatgcagtatttgtacaactgaaaaagacacccgaaagtgttctgcttaatggcgtatgggcttatatgcgcacaaagttatccgccggagatgaactttttatccgcttggaagaaagcacttcctctgcgcacattttaccggtctccatgccgctttcgatctgttatgaggacgaggatatcctcgccgtaaacaagccggctcaaatgcccgttcacccttctctgaatcattacgatcatacgcttgcaaatgccgtatgcggctattacaatgaccaggagattccatatactttccgctgcgtcaaccgccttgaccgtgacacgaccggactcactctgatcgcaaagcacatgttaagttccgctattttaagtaccgcggcagccagacgtgaaatatcgagagaatacattgccattgcctccggaaaaacacccgaatccggaacgattgatgctccgatcggacgtgttgccggatcgacaatcgaacggcagattgactttgaaaacggagaacgcgccatcacgcattacagacgtcttgcttatcatgacggattgtccctgttatcgctgcatttagagaccggacgtacccatcagatccgtgttcacttaaaatcaattgggcatccgctgatcggggattttctttacaatccgacggacacaacaataaagcggcaggcacttcactcctaccgcttaacgttttcgcatcccatcacaggagaatcttttgttctcactgctcctcttccagatgatatgcactgcctttttccagatttttcctgagatttatgaggtattctttttcatagggaacttttccctttaatacctcatatttgaggaaatgattcacttcatcttccccttttaccgccagcatcaccagtaataattccagcatggcttttgtgtcttcatttaaaatataatattttctgcccttcagataatactggagcggactgtccagtttgaatttatcacgctgataattctttgatgcagaaacgcggtccacatacatctccgctacatacttaatcggcatcttcatgccacagatcccgcgatgtgttttttgtccatctcttccatcaccgactccataatcaatccagtactccatatgatgtttatttcgtcctttatggtgaagccatgccgcagaataccctttatcttcacgttctgcgttattcggactcattgtcccctgataatatttgcatcccaccagaaattctgtcggtgtatacttcgacatgtcatgcagcagtccctgcttataaagtccgatcttaaaacagcctgcccggaccagatttttgtgatgcaggatcgtgcataaatgtttccatgcctttatcatgttcttttaccctctttactacttttatattccaattacaatattgatcgactgaccctcgattgctaaaagatgctgatcctcgaggatttctttttccggcaggaacgaattttccgctgccgtagtcatcaaaagataccatttcttgttctgcggaagtttcggcagcgcaagatgcgacagaccgctgtgaaaattatagccgatatagatataatcatccggtgtctgatctgtcttcttttcatattcgccgcaatacagaatccccgctgcctgtctgtcagccggtatcgaagagatccatgcgctctccccatgataggaaagatccgggaaacctttcctgccgtaatcatttaattccatcggatgttctgatgcgatgatcggatgctccctgcggaaatctgccagattttttataaattcagccagccatgtttccttcttttgtttcttccagttcagccagccggtcttattgtcctgacagtaggcattgttattaccctgctgtgagtttaagaactcatcgccccctaaaaccaatggaacaccctgtgccagaaactccattgccaacgcatttctaacctgttttttccgcagattatcaatgtatctttttctggtatttccctccacgccacagttactgctgtaattgaaactgtttccatcacagttatcttccccgttctccagattgtgtttttcacagtaggaaaacagatcccacaatgtaaatccattattattagtaatgtaattgacaaacccttccacgctgttttgctttctctgctggcagaaaaactcgttaaggtttccttccatatggttcagcatttttctcgccgggtacaggtattcatcactatatacatataaatgatgatatttttttgcattttccaaaaggatcggatcaaaatgtgtataaaacagctttgtccggctgagcagaaggtcctgtgccgccgccgtaacaggcagtgaatccccctgaagatgaaatccatccacatgatactcacgaacccagaaccgaagtgcatctaaaatcacattctggttcatccccggcgcaaaataaaattccatcacacattccatgccgttctcatgcagtgtatgtaccagttcccgaaactcagacgctgcatctgcactgctgctgtaggatgccttcggtgcaaaataattgcctggaacatacccccagtaattaatcttttccaccggctgtacactttccggtttgatcagatcttctccgtgactttcccacttaaggtaatccggcagtaccgttttctttgggatcacctgttcctcaaactcgtaggcaggcatcagctctatggtcgtaatgccaagttttttcagatatgggattttatctgtaatcgctcggaatgtcccccgttcttttctcggacaggatgtatcctccatggaaaatccccgcacatgcagtttatacataaccatctgctgccgtttaatctccggctgtctgtcgttttcccagtcaaatgcctgcggatatgcaccgccacagataaaataatccttctcactgcgggttttgtcattccatttttccctgccgataatacgggttgcataggtatccgtaatgatttttccgtttatctcataattgtatcttaaatttttccataacttaccggttacggccacagaacgcacggatccccggcaatattcctccggtactaaaattttgcagacaggttctgcttttttcccataaaaaagaatgctgcagttctcttctttttccccttcgaacgtaaaaatcactgcatcatcctttttctgtactcctaacttttcgtaattgccttctctgatcgtgtaatccatgctgtctgccaccttttctatcgtaccccagtatctttttctaataaaaatagtataccttttttttcacattttgtatagaaaaatatgttcaatcacatccgattatgttatgatgtcattgtctttattaggaccactataaaaaagagaggtatcggcatgagcgatttcaaccagaacaatgacgatgaagatatcgttgtaacccttgatcttgacgacggaagtcaggtagaatgcgaaattcttaccatttttacaattggcgaacgcgattacatcgcacttcttccattggatgaaaatggcgaggaaaacgaggaaggcgaagtatttatttatcgttattctgaagacagcgaaggcaatccttcccttgataacattgaggacgatgaagaatacgaagctgtatccgaccgttttgacgaacttttagacgaggcagccttcgaggagatggatgattaatccttcttcttttccggtggctgcgcttctttgataaaacgggaaatttctgcatctttatggttcagttgtttgactgaaaaaagatgcagatttttttttgctctcgtcattcctacataaaacatccttcgctcttcttccacttccggttccagcactgcttttttgtatggcatgacaccctcattgacgtcaatgatatagacattttcatattccagaccttttgcactatgtaatgttgctaacgcaacactgttcgggttctgattctgcacgcggtaaaattcctgcagctcttttgtgtaattttcaatgtggtcaaaccacgcatcataagtcttatattccctcgctgcatccaggagctcatccaaaacatcaatcagatcatccgctttgatacgtctgtaatccgcatattctgtacaaaactcatcatatccgattgccttccggatgtaattgatcgccgcatacggacttaatctctctaacatacggatatcgctctctaatttttcgatgcgctttgccacccacggctgttcctcatagtaccactcccacacatcaaatgccacggtctcctcgtctagcgattcccggctgatataacgtttcggacggttcatgatctgcaggaaatccctgcgttccctgcttcccatcgcaatccttatgtatgcaaaaatatcttttgcgatccagtgctcgtataagttcggcacggtatctctcgttcggaatggaatattatactccatcagctgttccatcagaagtcgcggctgtgtattggtgcggaaaagcactgcaaattcttcatattttgcgcctttctccacggccgcctgaatatcccagatgattcttgcattttctttgcgctggctttcaaacaactgccattcgaccgggatgtccccctgatccgccgcctctatttttttctgaaagcgttccttattgtggccgatgagatatccggcacttgtcacaatgttttttacggaacggtaattcacatctaaaagaaccgtctccgcctccggataatcatctttaaaatgtaacatgatctccggcttcgcgccccggaaacggtagatcgactggtcatcatcccccacgataaacagatttttccgctcacccgctaacatttttataatgtcatactgtatccggttgatgtcctgaaactcatcgatcaaaatatagcggtatttattctgccatgcggcaaggatatcggcacgctgttcaaaaagttccttcgtgtatactaacatgtcatcaaaatcaatcagtctgtttttgtacaaaaattcatgatattggtgataaacctttcggaacacggtctccgcacagtttttcgaataatagttggcgatttctatcccggaatttttgaccagactgatctcccctaacagagatgtgataaactccgtctcatcctcataggtcagatgttctttcgctatgatctcacgcatacactggtagcgctgttcctccctggcaatattgtctgcgctgtaattatatgcatgttttaaaatagcaaaatatactgcatgaaacgtgccaaatgtcaccggacatgaccggttcattttccgctgaaatcttcgcttcatctccgttgccgcagcttttgtaaacgtaatgacaaggatctgtgccggatctatcctacacacttcgatcagatattttgtacgttctgtgattacaagggtttttccggaacccggtccggcaagaacgagcatcggtccgtttttgtgatggattgcccgtgtctgtgatgcgttaaagctcatagattacctcaattcatagatttgaaacggcagggaaattgaaaatctccctgcctgataaaaaactcttactgctctaataattcaataccttttttgatgcgggcaatggactcttcttttccaagtacctccatcagctctgtcgctccgcccggtgtcatctgtttgccggaaacagccgtacggatcggccacataacataaccgttcttcacgccggtctcttccacatattttaacaatgtggcatataatgcatcattgctgtaatcttcctgtgcctctaacagaggaagtacatcttttaatacttttaaggaagtttccgcatttgtcttcatcttcttgtgtgtgtacattgccacatcatattccggaagtgcctcaaagaaatcaatatgctctttgatatccggaaatacttcgattctggtttttaccattgctgcaatcttctttaaatcaagatcctttgtgatcacctcgcggatatatggctctgctttttcatagaaactgtcaaaatccatagctttgatgtattcgccattcatccattttaactttgtgtaatcaaaaactgccggtgatttgctgattctgtggtaatcaaattctttgatcagctcatctaaggtaaaaatttctctgttatcttccggactccagccaagcagtgagatatagtttacaactgcttcacttaaaaatccctgctctaatagatcttcaaaagaagaatgtccgcttctcttagaaagtttcttgtggttttcatccgtgatcagcggcagatggatgtaaaccggtgattcccagccaaatgcatcatacagacgctggtatttcggcgaagaggaaagatactcatttccacgtaccacatgtgtgatgttcatggtatgatcgtcaaccacgtttgcaaaattataggtcggatatccatcggatttgatcaggatcatatcatcaagttccgcattatccaccgtgatatctccgtataactcatcatggaaggtcgttgttccctcgttcgggatgttctgacggatgacaaacggtttgccagcagcaagatttgcctccacttcttctttacttaaatgcagacagtgtttgtcatacatcatgatctctttaccgtccacttctgtttttaaggactctaaacgctccttgtcgcagaagcagtagtatgcttcgcctttttctactaattctttggcatatttcatgtagatgccggtcttcatacgctcactctgcacataaggaccataaccgccatccttatccggtccctcatcatgaaccagacctgtttcctctaatgtatgatatatgatatcaactgcaccttcaacaaaacgttcctgatccgtatcttcgatacgaagcataaaatctccgcccgcatgtttggcaattaaaaactcatataatgcagaacgcagatttcccacatgcattcttcctgtaggacttggtgcaaatcttgttcttactttgctcattgtttgttttcctcctgtattctcattttccgttttataaatccggaaaagattttcaaacgccgtacacgtcattatataacaattttttctgcctgacaagcttacaaattgaaaacagagacaggatttttctcctgtccctgcgctgccaagctattattttattattagatactttgccgacattatattttggtaaatattgcagtttctttcttcaaatcggttgcaatctcaaaattctcatccatacggttcgagatattttccatatccgtaaccagcacctgcgtgctgtctgctgcattgctgactccctttgcgccctcctcgatggcatgtgcgatcgtattgatggacttttgtatttcaaccattgtattcttcaacgaatctgtctttgattcaaactcgttcatgacattctctatgtaggtcgccttatttttatattcacttccggccgttacgaattcttcaaactctgggagaatcgactcgttcatatattgtaccagtccatttgcattgtctgctaaattatgcactgcctgagtcacaacactgttgatctgctggatacggtttgcagcttcctgactggcagctgcaagctgactgatctctgttgcaacaacagcaaaaccgcgtcctgcatcccctgctctggctgcttcaatagacgcatttaatgcaagcaggtttgtctggcttgcaatattcaaaatatcatccgtcaggctatttacctgatttacactgttactgtcctcaatcgccctgtttaatacctcaagaatctcattgactttcgtgccggtagattccatattagaacgcgcagcagattccatggaatccgcatgacctttcatttccttcgtataattattaatctcagttgtacgctccgcaatctgatttacctctcccgcaacagattccgtattggaattgatcaaagaagcattatctgacatctcctgcatggtagctgaaagttcctccgttaatgcagacagatcagacacactgctgtttgatgtcataacactttcacggacttcattgactaccgtttccatacgttttgaattatgaatgatcgttttaaaaatatcctgtaattttcccatgaaaaggttaatgccactgccgactgctgccacttcctgattctccataatggttactcgtctggtcaggtctccttctcttctgtctataccatcaataatctcattgatctcattcttcgttttagaaagtggtacgatcaccatcttcagtacggaaaataccgcaaacagtaaagatgctgtgctgacagcaatcgtaacgaagctgaccgtcaacgaatacttatataccttggtcaattgctgctttgctgtatctgcgttattgtttaccacttcctggattgccatgatattctgatctatcttgtctgcatactctgaaattgcaccgtttgccaaagcatacgcagcctctttgtctccattggcgctatatgccataagatttgcattttcatatttcaaaccttcataatttgacaatatcgcctcgtaattttcgcggtctgaatcatctataaactgttcaaaatctgacagatactcatcaagcaccgtctgttctgaacgtatgacatctacaagagagatcattgagtcaagatctgttgctacaatatgtgacaatccaagccgatgaatcttttctgtttctatctgaattgatcccaaatctgcgatacagaccatataaccattcgcaatctgtgttgcattctcattaaccttacgaatattttttactgccagaacacttgaaataatagatataattccaataacaaacaccggaatcaatatgatcattttcgtgctgaaacgtccctgttttttcataatgtgatctgtctcctatcctttattttgctgcggatgctgttattccttcaacaagtgtatccataatttcctgcagatcctgaccggatgggttaccggctgccatcgtatcactaaatgcagaacatgcatcccagtaactgtttccaacccgctgcagtttaccaaattctgattgtgcaataacagcctgaattgccggcacctgtttcaccgcatccgaagccgctgcattcgtattcgaaggtccctgatttctctcttcaaaacggatcgtctggttctcttcatttgtaagccagtctgcaagttttgctgcccattccggatatttggaatatgcattcacgcccatcattttataaccggtaaaagaagacatctgtacctgctgccctgccaccgtgtaagttggaagttttacggctccgtaattatcgccccatgcttccctgactgaaactgcattccatacgccactgattcccgcactaaccgtaccattctgtactcctgtaatgaaatctccatctggctggctgataaatgccggattggttgtgatatttaaaatggcctgtgccacatcaacgcctttaattgctccatctgtggcgttccagttacagtaatttgtcacgccatcatcattaataccaaactccagacccgtattaccaaaaaatgtatacagataccagcccgaattaagctccatggaaaatgatctgcctgcagcattcagtgcctctaacatgccatccatcgtctggacatcttcatcggaaagaacatttttatcataatagaggaagtatccgttatctgccgtcattggataagcatataagatatcattaatagatgcagcagaaaccgactcttctaaattcgcactctttacttcttctgcatttggcaccggatataatgcaccagcggcaaccattgcagaaagctgatcatccgcaaacgggaaaacatccgccccgttatgaatatctcccaaaagaatatcctttgtatcagaatcagcattttgttccaatgtaatctcaaactttgcctgtcctgcatatttctgttcaaagctgtctatcatctggtttaacatgtcgaagttgtcttcttccgaccatactttaagctgtaccacaccattatccgcctcagcatctctttctgtcatctccgtagatacttctgctcccggcattaccgattccacagcaccactattttttacattttctttatcagctgtgaagccacagcctcctaacgtcatacacacaactgtcgtaaacagcatacctgcaacaattcttttattcattcttattccccttctctgtcttctgctgttttaataccaatattttttattttatactcattttgatatttttcaacattttttacactctttttcgatttgataatacgcattttttacctttttatatgatgtctgctaaatgaaccaaaatcatcatttttacatatcttattgtaaacctgatattgaaaggaataacttattatgagaccttatcctatgtccgggaacagcaatcgttcctgcgaccgtttatctgtttcacatcctgcacaccgtgcaggtctggacttttgcacagaatctgcatcctgtgcagattctgtttcctgttcagaaaatataagaaccatttctgattatgtactcgccatggcatacgtcccctggcagcatttttctactgtttatgaaccggatcgttcactcagtgccgggactatttttccagaactggataaaccatttttagccgcaaacggaggtagatgccgatgatgatcagtcagatgaatcagtcccaactcctccactggatcgatatggtcagctttgctgtcgtagaaatcacagaatatctcgacacacatcctgacgatgaagaagctttaaaatatttcaatcactatgctgacttaagacgcactgcactgcgtgcatatgcgcaaaattatactccgcttaccatcgacaccgcaaatcctgataattactggcgttgggcatcggatccatggccatgggaaggaggtgactgttaatgtggaattatgaaaaacgtttacaattcccagtcaacattacaagacccaatgccaaaatcgcacagatcatcatcagtcagtatggaggaccagatggagaggcggccgcatcgttccgttatctgtcacagaggtatagtatgccatataataaagtagcgggactgttgacggatattgggacggaggaattggcccacctcgaaatgattgccgccatcgtccgccagctcaccaaaggcttaagtgctgaagaacttgaggccgccggtttcgctccttactatgtcgatcacacggccgggatctggccgcaggcagccggtggtattccgtttaatgcctgtgaattccagagcaaaggcgatgcgatcacggatctttttgaagatatggctgcggagcagaaagcccgcaccacctacgataatattttacgtcttgtcaaagatccggaagtctgtgaaccgatccgttttctgcgccagcgcgaaatcgtgcatttccagcgtttcggtgaaggcctccgcctggttcaggaagaacttgacagcaaaaacttttatatgtgcaacccggaatttgatctgggatgtggcaaatagactgcatgttctgcaagccggcttgttgtcacaaacaacattttgcattctattagcatgaaataaaatactgcgtacaatatgcccctccggcatttgtacgcagtatccatatatttctcatcataccacaacttattcaaatcaaacattacacaggcagacctgacgcaccggacagaaacttacatcgtttccatcaaccggtcaattgcattgatgatctcatcgatttgtggtttcatgcttccagcctttgaagaaagttttaatgcttcctccctctgatttttcatttcttcgacattatattccatccgatcccttaatttctgtctgcgcaggatcaggccgtgcttcacctcaaccatttccctgggatcaatcagggctgctgcctgcgtgatccagacctgtgcatcatataactgatactggttcaatgcccgcaccagtctgccattaaagtattcaagatcctcatttgtgcgttgatatttttcacgttcacgcactgcatccatataatactgccacagctgatttaattctgaagctcttcttacatgatacttctcacaggcataatcaatggcattcgtgatattgacatatttaaactttaccttattaagtaaaagaattgccttatttgcacttcgttccgctaacttgatctcagagtcattgtgcagcatctttagataatcggcacacaccgccactgcagtgacaaaaataagtaccatccatgcataatatgtatcaaccttaaatccaagctgtaacgtgataagtgtcactgccactgctgccacaattgcaagaatgatgtataataaattctttaaacttttctgctggtgcatcagatattcacggtgtaaaagccatctggatttttcccgttcaagatatttcatatccttttttatagtatcctgatagatttcattcgagctaaggcgtttgattgcatccggcatggttttttcttcctgctgaagctgcgtaaactgtgcatctgtcagttttttttctgaattaaggaaaatatttctcgcactgtttaactgaacgacattctgtgccacatccgcaatttttttcttttcaggttccggaagatcttctaatttctggacatcattcagataagacgtgactgttcggtactccgatttttcctcctcgatttcccttgtgatatcgatcatctgctctaatcgttccacaacatactgctccacctgtttcggatcttttatgttattttccgtcagcacagtctggctcagatcatccattttttcttcaaaactgcgttttttccatctgtcaaaaaatttcatttataccatacaatccttcctgtactgttttttccattcctcaagctgtgtctcccacacattttcatcccccggatcccactcatcaagcattgtctcaaactgacatatcgcatcacttctactgcagctgctcaattcatctgcaatcttttttgcttcctccggtgctattttaaaatattctctcctgcgttcaaatgcccgctcatcatgattacagcggcatgccatcagacactctttcaaggactctttatcactgcttttttcatatgcccttgcatagcagtcagctgcctgttcaaacaaaaacagcctcgcatatgcggtaccaagattgtgccacactgcgccaaccatctgtggcatttcagtttcacacgattgcagaagttttctgtattctgcaatactgctgatgtatttccggttctccagaaaacggtcagctttgattttcccacattcaaatgccgacttatgttccatttcctgaagtgtattccggatctgcttttgttcctctttcgtacaataaccacacgctgacatcagacagccggtaaattcagacaaaacacctccgccagccttgatattccttagattctgtgcaatatccggcaaatgctgttcattttccacccagtcacacaactcgtcatccataaagtctgcatccaatagacaggtattatttttaatataatagcacagttcatccagcgaataaacatttaacgatacattttcaatataatagggcatcgccgctaactgctggctgcataagatcaattcgcccattcgtttctcctgcctctcctttgtctactgtacattttccagtgacatcatatattcccatgttttgtcagaactcttaaatatctccccaaagccaaggtctttgatcctgatctttacttccatgtcggaaaccggctgtgctttgatgcgaagacgcgttgtgcgtggcggacgttcgggaagatctgcaagcgtgagtttctcaatcttcgcttccttgctgtttggcagctgcagccagaaatcgatctcgtttgatccatccagcaatacttcgcattctccaacagtctcgtaccagttatctcctgcactgatcagcgtaaaaaactctgtttttccctggctctgcactttcaggcttacattcactttcatctcattatcgcccatatagacaaactgccagctgttttcttccgtcatacactttcctgccgctgcataacaggcacccttggaataaagatttttccccataaaaaccctgcggcctttgcacaaaaaagaaagggactccttcatccattcaccatcaaaaccgtctccggtcaggtaaactgccgaaacaatatgccctcctgtcacttctgatacgatttttaaaaagctggcatctttatttgcccggtctatattccgctgttcctcactgatcgtgacaagctgcggcatggttctttgatcccgttccaatctcctgcaccagacctcatctccccggttgtcaaacagacacacatcatgcagccataattctttttgctggctgaatgcgaaataataaaaactctctctcctgtcaatgagtgtcagctttccctccggtattccaattctttctgctacctgaagaaagagctccgtcacctcccgcgacagctgttcaagcgtgataaccaaaaagtcaggtatcacaggattccccagttttcccgcaagatataccagcttttttatgtagagtgctaacagttcctgtgccttataagtttccccctctatgaaaaactcttttcccgcaagagctgcctgcagcagaccggatactgcttcctctccctgcaaaagtgccagacgttttgcctcctcaccgataaaccactgaccgatcccatgttttttggcaagtatcagaggaatctggtatacttcactgcctgccactgtgctgacagtctccggttctttcatattcaattggaaataactgatcacggcattgtcattatcaagatcaatgccaagataatacgacgttttttccacttttctccctcttacttataaaatacggaatacctcattcgttaccatctgcattccatagtattgtttcatttctctcttttgcatctcacgttctcccatcgcgtgatgcatcagcatgtcattcaacatttcataccttccatgagattcttcgtccggtacatttcggcaatttaagcaggcactttccgttatcttctcctccgccttttcctgctctgtcatataataaagtacagactcgccaaaaaataagacaaattccttgacaaaaacaccatcatagacctcatttaacagtgactgctcgtaatgttctccatccaggctaaaatgaatcataattttttgtcccggatctgtatgatattccacaaacgctttgtcatacaaatgatactttaaacgtaattctttctcaaactccaggaaaaatgcaaagcagcggttcttagacgtgtactcttccaacaattcatctgccacctgatacatcgcatctgataaatgctctttctctgagaaatatttcagcagccccagtttacacgcatcgttgagaggatttccttcctgataacgggcaaagatctgttcaaatacatactccggtaccaccatattcctcaccagccatgcatctgcaaaatacgataaatatgccatacagatcagttcccgtcccccgccttttacataactctcgtagatctcttcaatatccgcaatataatcagtcgaatacagcatctggcttaaaatacgttcctcaagatcaaacgtgtcaatatcaaatgctcccgcagctttccagatctccgccatcgtctttgttgcaccattataatatttacaaagatagataaggatcacatcattataagtgcctctgtaaaatacatgttctgcaaacccaagaaggaaatcatcttcctcaaaccctgctgtatgaatcgcataactgcacagagaaacgcatgcagccgtatccatgtgctcatacccacactcttctgccatgcgatacgcagtttcatacaaatgttcttccgtcaggtactgcatcagcatacggcgcgcagctgcagataacaatttatgatccagaccggtcagacagcccgcctcatactttcttttccggtaaaatgatatgatctgttcggcaatttcccttttatagcggtcactcacctgcggtgcttttaaaacagtccacacacccggaaaatctgaatcatccactccatccgcaactttttgctgcatggaatataaaatataggataattctccctgtgcaagttctgtacactttttcacacaatggtcaatatccatcagcggctcttcacaacaaccgatttcctcacagaaacgattaccataaatgtcctccatgatcaggcagtaatcctttgtatatacagtaaagtatgcagccccgttccggatcatggattccctgttattcacatgattgcatgctgggctgcatgcatattcataaacttctatctttgctgcctgtggatccgtacagatcatcttgtgcgtaaaaagaatttcagctgcccaatgcgcaatatcactatttataatcccctgttcaaacatttcatcatatatcacggccagattatcatcgatatgaccagcctccatctgctccatcgcaaaccgttccatgatcggcagatatttctgatatacctcaggctgcaccttttttgccgcaataatattgacaaataaaaccgctttctgctgccaggacaatccactgtcatactgaaaatacagctgaagcatctttggtacacgttctaattttcttccatccagtgataaaagatacgcttcatacaggctcgtgatgcggatctcacgttcaattccaagttcataccagtgatgatactttgcaccaaagcactggctgcggatcagatatcctaacaccgccgtcagcatttcatcatccggtttcacctcataacacgcctctaaaatatggtataaaaacggatgatattcttttttttctgaaataagcccggccacctgtattgctatatcccgtgtcataatgccccatcttgcagtccagtataatatgcgaacctcaaatgatccaagtctcgccagtaaatatggatcctgccagatcagataatatgcctccagataaaaatacgggctgttatcataacgcatccagtcacgaattgcttctaacctttctgccggcttctgataatactcttcttttaaaaataacagcacccagaacaacatcgaattatccggatgcagtttaaaaatctgttccacttccgtcgtcagacgatccacataggacggctcccgctccatcaatgtgcacagataaagataatacccccattccggactttcatgatcctcacacgtccgtttaaaatcatctaatatccaggatgcctcctgtctctggcggttgatgatcagcgtctgtgccttcatcagtccataaatcttttcattctcacacaaaacggaaagatgatccaaaataacccccgactggtttgcccatactccggtcacaatccgtttcaggcggtattccagataaagctgcattaattttatgcgtgatttctggatatcaaaaaaaacaggttcatccttcgttttattttcctgcttagtcgtggcacacaccgtatagatcaatggtttctgtcccggtatctccagacggatctttccaaaattccttcccgcatgcattttttctgccacaatataatattccacatcacagatacttcccacaaacatctcatcggtgacccgtggtttctttaaaaccagaaattctgcatccgaatggactctgatttcaagatatccatgccggtttctgttcacctgaaaagtttcaagtctgttttcatgcacctggtaaaatatggcactgctttcttccaatgaaaccacagtccgcttctttttgtggattccgatcaaaaactcctccactttctgtccggatggtgttcctttcgacaaaccctcatataaaagcatctcccttttttcatccggatgaaatatgtttttaaacttgcccgaataaaacagatgaaatgcctcgtcaaagtcgttttctgataatctggcaaaatcggataaatttttcactttgccaaccgaggattctgcatacagttttgaaacagacacaacaaaagaaaggttatattcaccctgttctactacgatacagaactctcctttttgaatatcaccttcgatcagaccataactatgaaattggtaacgaatccttatttcttccccttcaaactgcggtgtcagacattccatcctcggattggaagaatatacgattccacgcatcggcacatgatttgtgcttgtgatcacgaaatcccccgaaatatcattaccttccattgctgtgatgtcaatcttatccacagaaattgaaagagacggctttaagtgttcgaattttccccttgccagttgttgtatccgtcttcgcaaatcgacacctgctttttctctcttaattgcttgctttttcaatgacaatcattataatagattataaaccaatttggaggagttcgcaatgataaaacacaaagaccattttcacggaagtgatttagaaaaaatagaacagatttacggcatcaaaaaagaagagatcgtcagtttttccgcaaatgtcaatccgcttggcgtatcaccgcttcttcggaccgctctctccgagcagatcgatgtgatcacgacataccctgacagggaatatacctccctgcgcaaatgcattgcagaatactgcggcaccgaatacgaaaacgtcatcgtaggaaatggttccacggaactgatctctctttttatacagatcgagcacccgaaaaaagcgatggtcatcggacctacttattccgaatatgagagagagatttcactcggcggaggcacaacactctactatccgctccgtgaaaaggacaacttccgcttagatgtcgacgattttatctcccatttaaatgaaagtattgacctgatcgtcatctgcaacccgaacaaccctacttcatcctgcatcaccagaacggaaatgcgccatatcttagatgcctgcaaggaacatgacatttacgttatggtggatgaaacttatgtggaatttgctgataatatggctgaaatctcagccgtgccgctgacaaactattataacaacatcgttatcctgcgcggcacctcaaagttttttgcagcaccgggtcttcgtctcggctatgcgatcacaggcaaccgtgacctgatcaaatcaatcaataccaggaaaaatccgtggacgatcaactcccttgctgtcgttgccggagagacgatgttccgtgacactgcatatatcaaagccaccaaagatctgatttcttccgagcgagcaaggatctaccggacattccagaaaagtcctgattttaaagtgtatgaaccgagcggcaatttcatgctgatacgcattttaaaagatgatctcacttcacaggatctctttgaccgcgcaattcgcgagaaaatgatgatccgcgactgctccacctttccatttttagacaacaagtacatccggctttgcatcatgaatccggaggacaacgacagactgcttgcatgtctgctccgttaagtattcattaagtattagcagggaagttttgggacaaccccaaagcttccttttattcatgataatagaatgttcgcggagcgtgcattttattattttgggacataaaaaacgacagaccgtacgatctgccgttttttcatgaccatagattcctgtcgaatccataccatcgattcttttttcccctgtaattacatcattcccatgcccgggttacctgctggaactgccggaacatcttctttgatgtttgcaacaacagactctgttgtaagcagtgtagatgcaacagatgttgcgttctgtaatgctgttcttgtaactttaaccgggtcaaggataccattctcaaccatatctacatattcttcggttgctgcgttgaatccgataccgtctttggactcttttactttgttgatgataacagcaccctcaagacctgcgtttgcagaaatgtagtataacggagcttcgagagcttttaagataacctttgcaccggtcttctcatcaccctctaaggtgtcagctaactctgcaacagctttggttgcatggatatatgcagaaccgccgcctgcgatgataccttcttctactgctgctcttgttgcatttaaagcatcttccatacgaagttttgcttctttcatctctgtctcagttgctgcaccgacacggatgactgcgacaccgcctgctaatttagcaagtctctcctgtaatttctctttatcgaactcagatgttgtctcctcgatctgtccacggatctggtttactctgcttgcgattgcatctttgtcaccggcaccgtcaacgattactgtgttctctttctgaactttgacagattttgcacggcctaactgatccatcgttgtgtcttttaattccagaccaagatcagagctgattacctgaccacctgttaagattgcgatatcttcaagcattgcttttcttctgtcaccataaccaggtgctttgacagctactacgttgaatgtaccacgcaatttgttgacgatcaatgtggtaagtgcctcaccctcgatgtcctcagcgataatgagtaatcttgcgccgctctgtacgatctgctctaacagaggaagaatctcctgaatgttgctgatcttcttatctgtaattaagatgtaaggatcatctaatactgcttccattttgtccatatctgtgcacatgtaagcagatacataaccacgatcaaactgcataccttctactaagtcaagctctgtctgcattgtcttagattcctcgatcgtgataacaccatcgttggaaactttttccatcgcgtcggctaccatgttacctacgttctcatctcctgcagagattgcagctacttttgcgatctggtcttttccgtttactttggaagacattgcaaggattgcttctacagctttatctgttgctttcttcataccacggcgaaggatgatcgggtttgcacctgcttcaaggttcttcataccttcctgtaccattgcctgtgctaaaacagttgctgttgtggtaccatcacctgcaacatcgtttgtctttgttgcaacttcttttacaagctgtgcacccatgttctcgaatgcatcttctaactcgatctcttttgcgatcgtaacaccatcgtttgtgatcagtggagcaccgtaggatttgtcaagtactacgtttcttcctttcggtcctaatgttactcttacggtatttgccagtttatctacacctgcacctaatgctgctcttgcttctgtgccatatttaatttcctttgccatatctgtctacctctttctgaatttattaatgataaaaatatgttttactctacaactgcgagaatatcattctgttttacaatgatgtattcttctccgtctaattttacttctgttcctgcgtatttcgaataaattaccttctgacctgcttttacctgcatggtaacttcttttccatcaaccattccaccaggaccaactgcgataacctctgcctcctgtggtttttcctgtgcactgcttgtaaggatgatacctgattttgtagtctcctctgcctcacactgttttaatacgactctgtcgcttaatggaactaatttcatgttgcttacctcctgcttatgatcatctgttttatttcttttgagtagttattagcactcatttcttttgagtgctaacttatggttcatataatagatttttatatttgaatctgcaaccaaatatatttctatttataattatttattccaatattttcttattttttctctctttttctcgtttttttataagttcactcattttctgtgattttatactttttttattttttcagcggagactgttttaacgtgcgttttacggtctgttttacggtctccttcattgctttatttccttccgtccaaagcagttttaaggctcttgaaaacagtttctgccgctccggtgaaagtttactggtttccttcatcagttcctgtattttcttccatttactgtggtaaaaatcatctaccgtacggatcccgactttttcgatcatatcaaatgctgtctctacgatctgtgctctctcttccccgtctaactggtaaatccatgatttcatcgtttcatccagcaacaggctctgtgccgcaacctgatctacatgtacaaaagatcttccgagtacctcccatgacatggcatcgtgctgctggatcccgctgtttgagctcttgacaacttcaaacgactcctgatgttctaagagcattccgacaatggaagattccggcaggatcgtgtgcagcttcggcagcatgcgctggtactctgtgctttccaccatatcactccggaatcccggaccatcattgctgtacacatttaaaatctggttctggatctgcggatcacattttacggaggcatacacggcaaaatttccaccctttgaatggccgccgacacgcaccctctgctttttgtctgtcactgcacggttcaaatattccactgcccggagctgtcccggcgtttctgacagataacccatattaaaatcttcccgccagcccgtgatcgtgttgtccgttccacgaaatgccacatacaggctgtcatccggcagttccacacagaccgccgaaaactgaaactgttcctcatcccggatctcgttgacatagcagcgtagttttacatccgaaaaacgttttgtttccgccattttctccataacaaacggagccgatttcgtcatggatacccgcgctaagatttcgtctttatcattcttttcccaaaattgtccggatgcctccttaagcggtactgccggcgcattttcctctgcagtaacgatcccctcaaaatcaacatatgcaagctgcgctaaaatcagattatcaacttcattaaattcatctgcctcaaacgataaatcaccacgccagtccatatagtccatgatatttgccattgttttccccctgtcttttatttaaatcagcccataatgtttcagtccgttccagatcccatctttatggatatctgtggtaacaaattctgccgcattctttgccacatccgtaccatttcccatggcaatcccatgtgccacaaattcaagcatttccacatcattagcgctatccccgaatgcataggtatcttcctttgcgattccaagagacgcacagaggcgctcaatgccgcttgcctttgaatgccccgcctgcccgatctctaatattccatccggctcatggacgatcatatcaaactccgttcccagttcttttctgacaagttctacatctgcatttccaagttccgcactcagcttatttacctcatattgtgcagttccggtaatactttttaagttttccccaagctcatttctcagataaatgacatatggatcgtcgacaaaatctttttcatccacataaatatagttcggtccctctaagaccatcgggatctgatgtttccgcagcactgcaaggatatgcccgatctgttctttcgtcagcagcagttcaaacaacttttctccctcaaattcgatatgtgtaccgcatgccgccacgattccgtcaaatccaagtgcaagtaatttgggacttttaatatttgaccggcttcttccactgcatagaaatgcataataaccattttttctgagctcttttaatgctttttttgtactttccggaatattcattttaaaatcccacaaagtaccgtctatatcaaaaaatactgcttttttcattgtcgattatctttttcctttctactgtgttgttttttattctaacagaattcattccttaagcaaagtcttttcctgtctgaaacacgaaacctgaaatggacggctgctgttcagacacaaaaatgccgcgcaaccctattacaggtcacgcggcataaataacacataattctattcgcgatgcaatgctccgttcattctactcgcgatgcaatgccccgctcatattattcgcgatgcaatactccgctcgttttactcgcggtgcatggagaagctttccatgtcataattctttaagttatcatggatcgtacggtcgtctgcctgtccgatcagtgtatcacgattcttcttggaagatacctgatcattgaatgcacttggaccgccgacacaaccgccctcacatgccataccttcgatgaagtcttccggcagtcttgctgcttttaacagaagtaatgctttcttacattctgctgccccgtttgctttgcatacggttgctgcgatctcatcgttagactcttttaaactctcaagtactgcagctgttacaccgcctgagtttgcgaaacgtttaccaaatgtagaagctgtctggtcatcgtttgcacatggctgtaactcaacaccttttgctttcatcattgcacggatctcgctgtaggtcaatacatagtcagcatttccctcgatcttctgatctgccacttcagacttcttggcaacacaaggtccgataaatacagtgattgcttccggatcttttgctttgatcagacgtgaaactgcacacatcggagacactgttgtggacacgcactctgctaattccggataatgtaaacgcaccatatttacgaatgccggacagcaggaagtaactttcttatttccctctttatatgcctcagcccactcttctgcctcataagctgctgtcatatctccgccaagacctacatcatagaaatctgtaaatcccatctctttcatggctttcttccagcttgccatggtgatatcaacaccaaactgaccttctgttgccggagctgccattgcatatatatgcttacctgcttttaaagcctcgataaccggtacaataaatgttttggatgcgattgctccaaacggacagctgtggatacatttaccgcagcggatacatttttctttgtcgatcacggaaatgccatactcattgtatgtaatcgcattaaccggacagctgaatttacatggtctctttaaatgtgcgattgcattgtaaggacatgcctgtgcacatcttccacactctttacatttggaaggatcaatatgggagcggtctcttcccggctcaattgcgccaaatttacatgcattgacacatgcttttccaagacaattctgacagttttctgttactgtataactggaaatcgggcaatcctcacatgcggaactgataacctggatcacatttccatcatcctctgcacccggtgccttgccctctgctaaacggactctctgacggatgatctccctctctttataaatacaacagcgaaactgcggtgtcggacctggaatgagttctgttgcgatgtggtctctctcttcttcaagactgccttcaaatgcaagctttgcgactgtgtagagtacatcgtgtttgattttaatcacattttcatctgcatacatcgtgttttacctcgctcatcttatctttgttaactttttaaccatcttagacattatatattatctgtatggaaattcaagtacttcgcatgtttttattgagaaacacagtaagtttttcacctcttattgagaaaaagcgcctttcatgctataattaagctgttcgtctgcctgacgatcatacattttacaaaggactaagaaggtactgcctgtacaaaaccggagatttttatgaatacattttccaaactttacgatacagaattgcacaatcaggagatcaaatcaaataaacggactttaatggggttttgctggtttttcctgacactgctgcttgtctgggttttaaccatgattaatttctttctgatcagtaaatttttaatcagtctttcactgggatttacggtactcttactcatttctcctgtcattatctataaaaaggccgatctctcaagtccatggatcaaatatttatttctggcattgatcagtatcatctgctcgatcattaccgcactgcttacctatcatgcagttttgattttcgttatgccactgttatttgcgatccagtaccggaaacgtcaggcgctctggttttcctttatttttaacacgattaccatgtttatcagttcctatgtgggattttattacggactgtgtgacctgaatctgctcttagagagcacccatacaagaaactggtatctgcagactatgtccggttcttttctgcagattccttttaatgaaaatcctgtatttatcattgccgtctttgaagttttgccgcgtacactgatcctgcttatttttacgatcatgcttcagtatactatcatcagcagtcacaatgatgcccttaggattgcagagcttacctatcgcaaggatatggatgcccgcacaaaactttataataagaataaatacgaagatatggctgtaaattattatccatccgtcggatatattgccgttgcattctgggatctgaacaatttaaaaatgatcaatgataactttggacatgctgttggcgattccctgatccagaccatgtcagagaaattgcttgccgtttccaatgaaagatgccgtacttaccgtgtcggcggtgatgaatttctgctgatccttgatgatccggcacctggtgaaataaaccggatcatacaacaggtaaaaacggaactctcttccggcactggcactaccggtctccgtatccttgctgcagtcggttcggcagaaggatgtggagccgatatccgttcacttgtaaaaaaagcagatgccgccatgtattcagacaaggcaaagagcaaggagggcagatcatgatctatattcttacagcatgtttagttttggtatttcttttgtttttcacttcctatctgctatatcgcggtgtcttttattatccgcaaaaaaagcatgtcgacccgtaccagataccggatgacatgctctatgccccttataaaaatgctatgctccatcttctccatgaaatggagcagactccctatgaagaagtttctatccggtcacaggatggtctgtctctgtgcggcagactttatctgtttcgtccggatgcaccgcttatgctcttttttcatggatatcatggaacttttctctgggatggtctgggatcttttcgcttctgcaggaaaaatcatatcaaccttcttgtagtcgatgagcgcagccacgggaaaagtgccgaccagatcattacctttggtatccgggaatgcaaggatgtaaaatgctgggcagattacgctgcaaaacgctttccggaaaaatccctgatcttatccggtgtatctatgggttctgcttctgtcatgatggcatctgttctctccctgccgtcttctgtgaaagccctgatctgcgactgcggatacactgcccctgccgaaattatcaaagaaaccatacggtcttttcatctgccggtttctttctgttatgccctgctgcactttggcgcacgcattttcgggcacttcaatctcagtgaatcaaccgcattatctgccgtaaaacagacaaaactgcccattctctttatccatggggatcatgattccatcgttccaccaaaaatgtgcgacgaactttatgatgcctgtgcatccagaaagaaaaaactgatcattacaggctcccagcacgctgtcaacgcaatggctgattttgattcctatgaacgggagatcatgaattttctcaaagaatccggaataaagatttaaaacccaaaaccggcaaactctccaaataattctaacagctcaaagccgtttagcttcataagattacattcctctcccgtcagttcagatatctggcagcctttttgcacagagatcctgccactcagactgtccgtatcatccgattcaaacgtaattgttccgtcctttgctgcaaggtttccgctaatatttgtctgaatcgttgtcgttttctcccccgtcaaaaatgcgattttcatattctgtgtccggaaatcacctcccagaaacagtacctctatattctgtgcattttcatcatcctcataattgacggaaacagatgccagcttattctgatacaaatatacactgcattccatctccccggccgcagatattttatcataaaataccataaaaacttttcccaccggatccgcagatatttttgtcccgtccccgtactttttcttcacagccttctccgctgcatctaatacattttgggcattatccttgctgattgtaaactgataccccgcacagtttcttttctgaccatcaattttaaattcttttttttctgttttctttattttcagtttgttaaattctttccgcgcctcttttaatatatctgttccgatcgttttctgctcatttccaccatatagttcttccaaaatggtatcgaaacgttccagcttttccgaaccgatctttttcgcaagatatccactttttccaccattcttataatcgtatgtaaatactttcgagctcagtgacggaagctgtgttttcagctctttttcatccagtgtcattacaaattccagatccggcagcttatctaaatctatcgttccctttaactgtttctgatcggaaacggatgcatattctgcctggattttctgctctttccattgtccgtccatcgaaacggtgtaatcctcatcctttgaaacatctgcggtttccggctgatccttgatcgtatgatatgctgcatataaaatcttatcaccttttcttaaaaagaaaccattctttatccctgcaaacagtacgattgccaggattacaataattcccgcagacagcacccatattttctttgaaaattttttatgatcattttgcttttccattgtaagcctccatttagatcctgaaatatcaaattcatttttcccgttttctttttatccggtttattttattctttttttcataccttgtaaacctgttttcaactatttttatttccatttgtgctgctttctaatacaatgttttcatccgtacaataagcctctatacaataaaaacgccccggtattacatccaagtaacaccggagcgctctcctgcctgtctgttctgttttctaatccaacagattctgcatactctttaaactgatcaaaagtgttgatgtattatgcagtaacgccgatgtggtcggctgtaaaattcctgcaacaccacataatattaatcccaaattgaaacttacgataaagcggtaattgccgcggatccgtttcatcaggctgtccgataacagctttaatgttacgatctgataaagatcatccgaaccaactgtaatatcagcgatctctcttgcgatctcagcaccatcactgatcgcaataccgacattcgctgcagaaagtgccggtgaatcattgattccgtcaccgatcatgataacttttcttccggccgccttttctttctcaataaatccggctttatcctccggcaatacttccgagtaatactcatccacgccaacacgctttgcgattgctgctgcggtacgctcactgtcgcccgtcatcataacaactttcgtgatcccggcacgctttaatgaattgacgactgcctctgcttcctcacgaagaggatcttcgatacagattacgcctgctaactttccttcgattgcaagatacaggtgtgaatattctttcgggagagaatcaaacaattcctgttttccttccgggatcgtacagttttcatcttcaaacacaaagtggctgcttccgatgactgcacgttttccatcgatcgtcgtggaaataccatgtgctacgatatattccactttggtatgcatttcctcgtgtgcaagatttttctgctgtgcagcatccacgactgcttttgccatcgaatgcgggaaatgctcttctaaacatgctgcaatacgcagtaactcatccggttctgcaccgttaaatgatacaacatccacaacagtcggtttcgcttttgtgagtgttcccgtcttatcaaacacgatcgtgtctgcatctgcaacagcctctaagtattttccacccttgacggtcacatggtaaagactcgcctcacggattgcggaaagtaccgagatcggcattgcaagttttaatgcacaggaaaaatcgaccatcagtacggatatcgctttatttacatttctggtcagcagataagtcaatgctgtaccgcctaatgaatacggtactaatttgtctgctaaatgctctgcttttccttccagtgccgattttaatttctcggactcctcaatcatagtaacgatcttctcaaagcggcttgaaccgccgacttctttgacaagaacggtaagctctccctcttctaccacggtgccggcataaacagaattttccacaattcttctgacaggaacagattctccggttaaggatgcctggttgaccattgcctcaccgtcgctgactatgccgtcaaacgggatgacattgcccatatgtacaacgacctcatctcccggacggatctcagaagctggtacaagcacttcctgattctcgcgttttaaccacacttttcctacatttaaagacatcgtgcgcgccagatcatctacagattttttgtgtgtccactcctctaagagttcgccgatgccaagtaagaacatgacagaaccggctgtctcgatatcatttctgaaaatggataccccaatcgcagttgcatccagtaccggcacttcaatcttccgccgccataagcactgtaaacctttccagagatatttcacggatttgacggtcgtgacacatgcccggaatgggtacggtaaaaacatcctgcccgcataacgacagacgatctttccgatcagtttttcctgatattttgcatttaactcacggccggaattttcaatcactcctgccggaacatccactttttcataggaaaactgctgtaatgtgcggattatctctgcacggtctccgacataggagatcacagcgtccccggtgcgctcatatactttcgcaaatgtcacatatttattgctatgtaaaaaataaaggagcgtatctgcctgctcatagctcatccggtactgagacacatggatacgcatacgccctttgatctcatgtttgatgacaaacttcatttttctcactccaatcaatagtaaaggaaagcaccagggtatttttcccggtgcttcctgtcgcggtcttgatatcgccacattctttatcatggcgatatcaagaccgcgaagcgtgtaatctattgttttatgcttcttctgctgcttcgttctctgctgtgctgtcctctgcttccgctgcctcatctgcgaatgctgccgcctctgctgctgcagcgcgctcctcgttaatgttcttagcttcctcgtaaatgtcaccagcattttcctgaacagttgtaactgtgttcatcacgcactcttttgcgcggagaactgctgcggtacagtttgtgtaaactttctttgcatccttgcttgagagaactttgatacctgcggttccaaataatactcctgctgcaaaaacacctgttttcttccagttaatcgctttcaaacaatctaacatcttatgtacctcctgtggatttaattatttgtattagctgtcattttgggtcagaatctgactattttctacaaaatcaactgccctctctatgacattttcacgattatatacctgatttttccaattttcaataaaaaaacgggcaaatgataaaatttatcatttgcccgttttttcatatatttatgaacttttttctatttcgtattgagcgtgcgcatggagtttaagatcgcgattacagaaactccgacatccgcgaatactgcttcccacatatttgccataccaagggcacctaataataataccagagctttgactgcaagtgcaaatacaatattctgttttacgatgccaagtgtctttcttgcgattttgaccagtgatgcaatttttcggatatcatcatccatcagtacgatgtccgctgcctcgatcgcagcatccgaacccatgcttcccatggcgattccgatatctgctcttgtgagtaccggtgcatcgttgataccatcaccgacgaatgccagtctctctttttcattctgtgcacccaacagtttctccacctgaccgactttgtctgccgggagcagttctgcatgcacttcatcaatgccaagttctgcggcaacggcatctgcagccgcctgtctgtctccggtcagcataactgtctttttcacaccgacctgtttcatatcgcggatcgcatctttgctgccctctttgacagtatcggaaatcacgatacttccggcaaacacgttgttgcatgccacatagacaaccgttccggcagtcttgttttccgtgtaagcgatattctgcgcgtccatcagttttgcattgccaaggtatacttccctgccatcaataaatgtatggattccgtgtcctgcgatctcctccgtatctgtgacgcgctccatggaaagtgtttttccatatgcttcgcggatagagttcgcgatcggatggttggaataaccctcaccgtacgctgcgatctccaacaattcttcttttccgattgtgttgtttttgtccgcggaaggctgtacttccgaaaccttaaattcacccttggtcagtgtaccggtcttgtcaaacacgatcgttgtcatctcggcaactgcctctaaatagttgcttcctttgaccagaataccgatcttagaggaagcaccgattccaccgaagaaaccaagcggaacagaaatgacaagtgcacacgggcaggaaataaccaaaaagatacatgctctctggatccagtctgcccagccaccgcctaagatcaacggaggtaaaatagctaagatcactgcaccgatggtgacaaccggtgtataatattttgcaaatcttgtgataaagttttctactttggctttcttactgcttgcattttctaccagttctaagatacgggctaccgtagaatcctcaaatgcttttgttacttttactttgatcgtactgctaccgttgacacatccgctgatgatctcatctccgactgttgccctgcgcggtacagattcaccggtcagcgctgcggtgtcgatcatggaggttccctccgtcacgattccatcaagcggaatgcgctcgcccggttttacaacgatgatcgttccaacttccacatcatccggatcaacctgcgtcagcacaccatcttcctcaatgttggcgtattccggacagatattcatcatatcggaaatggactgtctggatttgccgaccgcataattctggaacagctctccaacctgataaaacagcataacggcaactgcctcggaatattctttcacgccaaacgcgccaaaagttgcgaccatcatcagaaagttttcatcaaacacctgtccgtgactgatgtttctgactgccttatagacaatgtcataaccgatcaccagatacgggatcagatagatcaggaatacaagccactggctcggtaactgctctaacactccagtatgctctaaaaccattaacactacaaacagcacaaatgcagtgataatacggtacagcatttttttctgttttgatgtcatattgattcctcttttcttcatttatttcatatgttcatgtattcatatgttttcttttttgtaagcccggtatgcatctgttttcaaccctgtactgcctgatctcttttttcctgcagcatttttatttcgtgcagatatatgatcacgtgcagcactcctttggcataaccgggctttccctgtatgagactgactgtcacatacaactatgtttttgttttacctgattttttttacattaaaatcttgcagtccggctcaacctttgcacagacttttacgacttctttcatgatgtcatcgaatttgtcatccactgcatctaccatcattttctgtgtcataaagctgacatttgcatcgttgacaccctcgatttttttgatagcctcttccatttttgctgcgcagtttgcacagtcaagatcctcaagtttgaatttctttttcataattgaatcctccattttctttttgatataaattttgtttttacttactcttcgatatgttctcttccctgatcgatgatcgttcttacatgctcatctgccagtgaataaatcacggactttccttcgcgccgtccggtcacaagcttcgcctgttttaaaatcttaagctgatgtgaaatcgccgactggttcatattcagtgactgtgccagatcgcatacacacatctccgactgaaacagtacgaacagaatccggattcttgtggaatctccaaacactttgaacagttcggcgagatcatataattcatcttcgtcaggcatctgttcatttgccgctctgatcttatcttcatgaacttcatatgcctcacagcacggtacatcgtctattgccaaatcttacacctccagtctttcacattatcatttgaacatattcttatctgttcatatgtttatgatagtactggtatgtggatttgtcaagagattagaatataattttcattctttgcgttttatattgttactgtccactcgtacttcgttccagtaacggattttgccgatgcttcgcattccaaatcggcaaaatctgctaccaccactgtatcatacggcattttcagttcagaaaatgcctgcctgtaaacagtaactttatattctccgtatcaaagcccacgcccccatcatcagatctgccggaacaatctttgctgctgcccggtgcagggtacatacgatacccggtgtggatactgccagcccaagttttgcatccagcagtgcatgacgcgccacatttttctgtcgggaagcaagcggaaaactgtgaatataagaactgtcactgctcttctttgcccgcccgatgaactcggtgtccttgatccagtaaggacagacagcggtcacacggattcccgtaccgtaaagttccacgcgcagcgccctgctgtaacgatataaaaatgctttcgttgccgcataaacactcagatatggaaacggctgaaatgccgcggtcgaacagatctgcaaaacacgcgcaccgcgtttcataaaaggcagtgtgatctgtgtcatggcaacggctgctttacaatttaagtcgatcatgccatccacatccactcttttgatatcccgccaggatccgatctttccgtaccccgccgcattgatcaagatgcgtacatccggtttttctttccagagcatcgcctctatttcatgcagtgtctccgcctttgtcagatccccggtaatgatcctaagatgtgtctgaagttctttttccaatgccgtcaggcggtcttttctacgcgcgaccacccatatttcatctagtttttcctgtttcctgatctgtctgacaaactcactgccaagcccgcttgacgcccctgttacgattgctattttcataggcactattcctttcctgatatcctgatcattaagtatttttataatttataattataacaaattttttcctttcttacagtcattgtgcactgatacggcgggcaaaaaataaaaatgagaccacctgtacagtagtctcatttttatataataaagtaatttttctgattaaccagaatttcttaaccagaatctgttaaccctttacactgccaagtgcaacaccctgtacaatgtgtttggataagatcagatatacaatgataaccgggaagatggaaaatgcgatcatcacatatacctgccccatgtcaaacttgagccagtcagctccacgtaactgtgcgatcaggataggaagtgtctttttcctgtcatcatgtaaaaccagcgccggtgtgaaataattattccagctgcttacaaaagtaaagatcatctgcactgcgatagcaggtttcatcaacggcattacgatagtattaaatgtatgaaattctcctgatccatcaatgcgcgctgcttcgatcagtgacaacggcaatgtactttccatgtactgtttcatgtagaaaaacgtaaccggagcggcaattgccggtacgatcagaggaatgaaggaatcctctaatttcatgctggaaacaagtttgataaatccaagtgccgttacctgtgtcgggatcatcataatcatcaggataaacggataaatatattttttcagtttgaaatcatatgcatggatcgcataagctgtcatcgtcgaaaaatatacactgagtactgcactaagggaggaaacgatcagactgttgatcataccgttccacaccggaagtgttccattccttaagtttttccagttttcccaaagatggctgctcggaatcaatgtaaaacctgactgcaactcaccgtttgatctggtcgcattgataaacagcacataaaaccagaataaacacaaaacagagacaatcgctaatacaacatatgcaataaatcttcttgcatgaattcctacacctttttttaaattacggttctcattcatacttttcaccccttcctcttatcattgccggttatcttaaatactaccagacttaaaatacctgtaatgataaacagaacaactgacagtgcaccagccataccatagttcttgctgtagagatgtttatttaagaacatgatcagcgtcatggtagaacgcatcgggtcaccggttccattggttaagatctgtggcacatcaaataactgtaaaccaccgatcagagatgtgataaccacatatacaaggattgggcgtaacagcggcagtgtgatctgccagaatacctgcgaagaagttgccccatcgacctctgctgcctcaaacagagaggtatcgatacccatcatgcctgccatcagaaggatcgtcgtattaccaaaccacatcagacagttcatcaatgcgatcaatcctcttgcacttcctacattcgataaaaatttatacggtgtatcaaccaatccaatctgcatcagcattgagttgatgggtcctccatcagagaacaacgtaaagaacaacatggaaaatgcagatgccatgatcagattcggcagatatacaactgttttaaagaaacgggttccttttaatttaagacgtacatcggagaaccaagcgccaagtaccagtgataaaatgatctgcggcacgaaacacatgatccataataccatagtattttttgtataaacccagatatctccatcagaaaagagtttttgatagtttgcaagtccgacaaactttggtccgacctgtgtcagtcctgacatatagttttcaaagaaactgttgtaaatagtgctgactaatgggatcagctgaaaaataacgtatactacaataaatggaatcaaaaagatatacccccatttattgtaccttactacctttccactactttttttcatgataatctgacctcctttttcagagtgtattattttcatccacagagctcacagcatccttcacctttatcctgtgtaaacatgctgtcagctctgcgcttggcattttaacctgaataaaccgcacctgccttccttattgcattccggcaggcgcagcttttcattcataacaacagaatatccgcagagcgtgctttccattgttatttttagatcattcatcttcttaatatgttaattccggatatttctctaaaactgatttgtaaaacaagtctaatgcctcttctttcgttgcacttccttcaaaatagttcttcattgcatgctgaaattcttcgttgcatccctgatcgtatgaagaaagattacttaaatcaagtttggatacaccctcattataaataccaagcggattctgtccgcctaagattttacttgcgtaagagctgtctgccatctcaacgattacatcctggttgtttacaaagtcatcatctttctcgatgatctctctcataacatcatcattggttgtcatctgaagcaagatatcttttacaagactctggttatccgttcctgttgctgcacagatccatgtaccaccccagaaaaagccctgtggtccttcggttgcaccccagccgccgttgtaaccgatactgccttcggtatctgctgccattgagaagtttactaaccatgcaggtccaaagtagcagaatacatttccttccggatagaagcctttcttccagtcatcactccacatatcatatgttcctgtctcgcctgcatctacaagctctttggaatcatccacccatttcataatgttgtcatcaatattgattttgccatcaacaacccatttggaagaaacgttgttggaatatacacggtatgtatcatttacggaagatgtgatggtgtagccggcatctttcatcttctttgctgtatcattaaatgtatcccagtcttttacataattctgaacctctgccggatcatcagaacctaatactgcttttgctgcatctctgttatagaataatacgccaggacaaccctgccatgaaagaccttttaatacaccatcagaattggtaacaacatctttggtgtactgatactgtttagaaagatcttcatcggtaataccaaggtctgtcactgccattgtgtagtcggtatcaacatatttcaatgcataatcagcttctaccaggaagatatcaattttatcatcatctgctgcatcagactgctttaataaggctgcatccaggttattctgatatgccatatcatcactcggggtaatgttccattttactgttacatcaccgatcgtacctgtggttgcatctacctctgtatatccaggataatgatctgtcagacgactcttgaactcctcattccagcagtagatattcaatacttttccctcatcagaagtacctgtctctgcgtctgtacctgctgtctctgttaccggcgcagtgtcttcttttgctgtgtcattggatttctctgctgtgctgctgtttgctgtatttcctccacagcctgccagtaaagctgtccccattgctgccacaagcatcatacttacgattcttcgtttcatttacttttcctccctttttataagcacctttggaacactttatcttttgtgttcctgtcttgtttacaagtgatatattaccggatttcagctctgcattatattaaatcacttgaaaaaatatcagattcatgacataataatgcgaaaataaaaaacaggagtaatgctatggaactttcaaaagaatggtatcacacagaattaaccaacagtgaatacgatatgctgcaccgttccccgactgttgaatattctttttacaatgcagtcaaaaccggtgacatggattctgtgatacgaaactgtaaggaagatgccttcatcgacttaaagggtaccggtgtcctttcccgtaatccgcttacaaatattaaatatcattttgttgtcactaccgctatgatcacgcgctattgtattgatggtggattagagccggagcaggcttaccgcctgagtgatttttatattttaaggatggattcgtgtaccaccgtccggcaggtggcagatctgcatcatgaaatggtaaaagattttaccggaaaaatgattttacagaaaaaaagttctatactctcgaaaccggtcatgcaatgtgtggattacatctatacacacatcaaagaacgcattaccataaccactttagctgaatataccggtctgtctgaaagttatctctcgcgcgttttcaaacagaacctcggcatatccatcagcgattatatccgtgaaaaaaagattgaaaaggcaactcatctgctgcggtattctgacaaaccgatcgtcgacatcgcaaactatctttctttctcctcacagagtcatttcattcagatttttgaaaactataccggactgacgcccaaaaaataccgggataaatattataaatccatgtggtaatgcatgttttctaaaaaaagcagcatacaaaatctgtatgctgcttctctcaccctatcagtcatttttacatgttactcttgaaaaaacacatcaattctgtgacatttttttgggtcaagtgtttcaatcacactcttccttaaccgtacaccatattccggctccggttccaatacgactttctcatcgcacactgcccgtctgatctgctctattcttaagtccttcttttccggattatgcattatgatctcaaatttcttcctggcaaattccagcttcaatccagcactgcctttttcatcaaactgttccggcagcagagatggtgtgatcaccagatctccaagatctccttttacaccaaatacctctgtgatcatcgtcagcatataccagctcgccgcacctgtcagatatgcataaagtcctctgccttcattatcaaaatactccggcagtcccgggtacattttactgttttcaaaattcattgcggcttctaaaagtgtctgcagaactttatgtccctcccggataaatcctctctgatacagtgcattcgcatacatgactgtcatatgggaaaacactgcaccattttctttttccccataggcaaatccaaacattcttccgagatcaaatttctcctctttaaaatctgtattcagacgatatccaccggctttctgatcaaacagaaatttgtctgcactcctgcagatttcttttacctgttcctctcccgcagttttgctcatgactgcgaacacctgtcctgtcagcatcatgcggacttcatcctttttactgtactcaaccgcatttccatgattgtcataatatccgttaaaccaacccatatcatccccggcactgatccattctttctctctgatatgctgcatcagccactctgccttctccaccagattctttcgtatctgttctgtggaaaccaggatcatgcctccttttacattatgttcgcagaggctggtatattcgtccagcagtttctgctttctgtccggactttcatataattctgttccttccgcaagcagacatttcatctcttctgccatttcaattttactgatcccggttttctcttccatatgcttcagacaatctgcaatatcttttaaatttccagcatatgcacacgtaaatgccacactctcgcctttttcccatgccatgtcaagtgcatcattccagtccgcaccgtgcagtctcatctcattatgctctccgacatcataaaaagcacatagattctgcagtaaaatatgttctaaaattgttccaaaataaatatttccacctgctgtgcgctgtttatttccatatgcatgatcccagttattatcatgtgcagtacctctttttgtctgcagatctttgaaataggttaccttctccagcaaaatatcaagatctcctgtctgatccagatataattttgtcgtcacaaacggccagaatgcatgatccatccatacgcgtgtaatattattgcggtctgcaataaattctccctgtctgctgccaatgatcgttgcgttcgttccatccatccttacaccgccataattgtcaacgatcatctggcgtactactgacggctccatgatcagcagagcaagacagtcctgccagagatctctccagccacgtcctcctttgccataatcatgatatggtaaaaatgaacagccataaatgcggcgcagaaccggctgaaaacagatccattttaaataattatcaatgtttgtatcacccgttgaaaaatcaacatttactttgtccgtccagtgtttttttacggcttcaaatgccttctcgatctgttttttcgtacggtaagcagatgtcattttctcaatattctgtttttccccggaaacccctgcaagtaccagatacgtgactgtttcctgtggttttaaggtaaccggtgcgaaacgcattccacctgctgcctcttttccctgcagttttgttcctgccagaacaccgtccttatccattcttaccgcttcgggattcaggtaacttcccccttccccgataaacatttccgttgtcggatagaatttttccggcgcctctccctctcctgtagatccatatacaaaatagaccgtctgatttttctgatggcccctctcatcaaaggaaagcaccgggcacacctccacgccatacgtttttgtttcaattctgtgcagcagcgacgtcacatgacgatgatccctgatattgtctgcactccgtccataaagcggaatcacagcaaccggtgtaatcttctgttcctgatccgctgtattggtcagttctgtcatcattacttccattgtcccatctatcgtaacaaaggaagtggtttctgctttcatttcatattctctggatattctcgtcagtttctgccacataaaaccagcttctaatatgctttcatcctgatcctttgtaaattttgccgcttcctgcttcgccgaggaaccacagacggaccagcagcccttattttcaatacgacaccagaaatttctcgtattgcggttattatgtaaattttcaatactgacaggttctaacagaaaatgattctgatctgtcttgctgtctcctccgagatttggcgtgatactggattttaaccctgtttcacctgccagcggaagatacagcccgctgtaattttccggattatgaatacggaaggttccatttttatctgtaaattctatcttgttcataaaactctcccttctttacatgacatattttttacgacataatcagttctatgtctgtctcatcagtaagcacagtctgcggaatataattatctttcatctcctgtccattcacgaaaagttttttgcagccgctctcggcatgtcccggattttttacggtaatatgcagatgacatcccctgaaatccttatctatctcaaacagttcccactccttcggaatcgacggtgcaatgcgaagtccataaaggtcaggacgcatgccaaggattccctccacacagcccaccataaccgttgatgctgtcccagtcagccagtgtacatgggatcgtccaaaattcggactgtctttcccttccgtaaactgcccataacagtatggctctaatctgcggatctctgccttgtcattctgcgctgccggagcgttctccataaaataagtaaatgccctctccccatgtcctcttaatgcttccgctaaaatgatccagccctgcgactgcgaaaaaataccggcattttcttttgttccggcattgtaaataactgcaagagccccgtcaaatgcatgttcatggtatggaggatccattaagattgctccatattccgtgtttaacctgtcataaacctgctgtaatgcacagtctgcctgtttctcatctgcaagtccgctgatcaccgcccagctctgagggtttaaccacatatttgcttccggatcagtacgttttccaatcgtctctccactctccgtaaatccacggataaatctgtcttcatcccagcagagttcctggatcagatttcctaactttttctggttttcatccagaaatgcaatgtattccgtatcctttttatgttctgcaaaaatgcgtaaaattgtcattgcataataaaactgaaatgcaacaaacgttgactctccatcttttccaagtcttaaacagtcattccagtctgcatagagtccggctggcatgctgtgctttcctagatggttcatggaaaaatcaatcgcacgtttcaaatgttcataaaccgttccttcatctttatttgcaaatggaattacctcatccataaatgcagtatcgcccgtttctgatacatatttgtatactgtcgggaacagccagagtgcatcatctgcccggtaagccggatgtcctgtttcctgtacataagaagcatcgtccggtgtatcttcatgtcctggattgtgtgtaaatttaaccagtggaagtcctcctccgttatccacctgtgcggagagcataaaacggattttatctactgccatttccggtgccagatgaatcacaccctgaatatcctgtaccgtatcgcggtaaccatatccgtttcttaaaccgcaataagtaaaagatgccgctcttgaccagataaatgtcataaagcagttatatgcattccaggtattgatcatagtatcaaattccttgctcggtgtcttaacctggaaatgggaaagttttccatgccagtatgccgtcagttcttccagttcttttttacatactttctctgtgttctcatatcctgctacaatttcagccgcctcatcgtcttctttcattcccacaagaaacgcgatttccctggtttctcccggtttcagatgaagtacggtggaaatggctccgcagccgttttcattataatttcccctgttatttaaaacgccgtcttctacccctttgggatttccatatccatgatatctgccaaggaattcttctttttctccacaccaggaatcagcttttgccccagcaagtccgaaaaaccggttgatcacggtcttatggtcaatttcttttccattttcaatcttatcaagatttgcatggatcatctggcggatgcggttttcacagaaaactgtccttgtgataaactgtgaatattggagatttacctgatcctgctcataattactgttattcgtaaattccgcataaccggtcacggtcagctccctttcccggtcagaatcgtttgtaatgccaagattccacacttcatatgactgatctaacggaacatagtaccgcacttctgaactgataccgtcagacacagctttcatctttgtatatgcagtgccatgatggcactcgctcttataagtatctaaactttttccaaccggctgccatgatgcagaccagtaatctctgttttcattatccctgatataaatatatctgcccggttcatcaaactggttaaagacataccttaaaattcttccgtttgctcctgattttgcaaaactatatccccctgcattattggatataattgctccatactccggcgaaccaaggtagttgacccatggtgccggtgtatccggtcttgtgatcacatattcttttttactttcatcaaaatatccgtatttcatactgcccctccataattatactatttcattcctgctttctattgctatgataccttaactataaaggttatctgaaaatagttatacaaaatatgtccttaaaataacagattcatgacctgtcctttgcagatatactttggtcaaaaaaacttttcaatatatcaggaaattaccggatatttttatgtactttttaatttataagacgtaatttcctataaatcaaaaaaggaatcccatatctgggattcccacatttttttattttctatgcaatggctgttttcttctgttatttcataaatccaaacagcccttttttcttatatggttcttttttgactgcacctgactcatatcctgttccgtcaatgacagcctttaattcctgctcatcaatatcctgctccgtgatgatcacggtctgttttttactgtgagaggaagatacttttttgaccggaaatgcgccacgaacagcttcatttacatgattttcgcacattccgcactgcattccatccacatccactgtaatctttaacatatttactccctgatctgtcagcccgcttcctcacagtcgcaggactgtactacgacgcttttaattctttgtttatcgatataaccacatgctttcaaacctgcacgcactaccgcattccagctttttgccgataattcctttatggtatcatcatcaagttcgatcgtacatgccttttctctgtcacataccgccccacatgcgatacgatacatattttttctactgatagccccgatttcttctaataaattgaccatgcgataaacagttgccgccccgattcccggatcaacttctgctgctctgtaatagatttccttgcagcaagaacaatcttcattgagaatcacgtccagcagcatcagacgctgcttggtaatacgacaaccctgttctctcaatctttgaatgacaatttctttctgcatctgggttctgtggtaatttgccgtttcatgatttttctttttctgactgtttactcctgccgtcatggtctcctcctatattaatgacagtgccctccgcactttccacaatcgcctccgcactgaagggattttccgtttttcttatcgcgaaccatgctgcggatgataagccccacaattaccacaactactgctcccgttacaactgttcccataagataatcctccttgttttccgaaggaaaatgcctgctatgcctgcatagcatgtgcctctgcaggagcagaggattttccttcttattatgaatatggctgccgtgtcaacacacggcagccaccttagaagcagtgcttatcttgcgcctgccatgccttttacatttacttttaatgtatcgctctctttgtaaggtctgaataacagatataaaagaccgattacaagtacaaaagcaacaacagttccaataccgaatgtaccggttgtgatcaatgtaccgatctggtagatacataaggatactacatatgctaaaccacactgatatccgattgcaaaccagaaccattttgtattgttcatctctctcttgatagctcccattgcagcgaagcaaggtgcacataagaggttgaataccagatagccgtatgcagctaccggagtcataacagcggcaaggttgccccagaattcagtaccatcttctgcaacttctgcgaaaccaaataacataccgaatgttgctacgacgttctcttttgcgatcagaccgctgattgctgcaactgccatcttccagccgttaccactctgtgtccatccaagcggagtaaagatccagccgattgcagaaccgatctttgcaaggatacattctgcctgggcagcctcaagagcagcaccctcaagtccatcgaaacttaacataccaaagcctgcatctgtccatccgaagttcatcaagaaccataagatgatggttgataacgtgatgatcgtaccagcttttttaatgaaagaccagccacgctcccacatacttcttaatacgttgccaactgtcggccagtgatatgccggaagctccataacgaatggtgccggatcgccagcgaacatttttgttttctttaaaataatgccggagcatacgattgctgccacacctacgaagtatgcgctccatgcaacccatcctgcattgtcgaagaaagcacctgcgatcaaagcgataattgggagttttgctccgcaaggaataaaggttgttgtcatgatcgtcattttacggtcacggtcgctctcaattgttcttgatgccataacaccaggaacaccacatccactaccgatcagcatcggaatgaatgattttcctgaaagtccgaatttgcggaatacacgatccatgatgaatgcgacacgtgccatgtaaccacaggactctaagaatgcaaggaacaggaacagtactaacatctgcggtacgaaaccaagtactgcacctacaccggagatcacaccatctacgatcagacctgtcagccagtcagcacatccgatgttttcaaataaactctgtgcaccagggatgatccattcaccaaacagcgtatcatttgtccagtctgttaagatagaaccaatcgttgttacagatacataatataccaaaaacattacaactgcaaagatcggaattgcaagccagcggtttgtcacgatacggtcgatcttatcagaagttgtaagtttctctttgctgctctttgaaacacattcgccaatgatggatgaaatgtatacataacgctcgtttgtaataatactctcagtatcatcatcaaacttatcttccatttccttgatctcatatgatacatccggaacagatttcatctgctctttgatcttgtcatctttctctaataacttgatcgcaaagaaacgtttctgatcctctgaaacaataccgctcagtttgttctcaacctctgtgatcacatcttctgcatctttagagaactcatgtaccggaaccatgttcttcttctgctgtgcaagtgcaactgccttttcagcagctttctggataccggttccctttaatgcagaaatctcaacgacttcacacccaagctttctacttaatttgtcaatatgtatcttgtcaccgttcttctcaacaagatccatcatgttgattgccataataaccggaatgccaagttccatcaactgtgtggacaggtaaaggttacgctcgatgtttgtaccatctacgatatttaagatggcgtccggtctgtcgccgatcagataattacgggcaacaacctcctcaagtgtatatggagataaggaataaatacccggtaagtccatgatgacaacatccttatgtccctttaatttaccttcttttttttctactgttactccaggccagttacctacgaattggttagagccagtcaaagcattaaataacgttgtttttccgcagtttggattacctgcgagtgcaatttttactgccataacttttctccttttatttttagtttgctgtaacttgcttttgtttgctacggcttgctttcgtttgctatagcttgctttagtttgccttttctgtcttttgttagcgcattctaacacaaagacaaaaaaaattactctacctcgatcatctcagcatctgcttttcttaaggataattcgtatcctcttacagttacttcgattggatcaccaagcggtgctacttttcttacatagatatccacaccctttgtgatgcccatgtccatgattcttctcttaaccgggccctcgccagtcagttttttgacctttacggtactgccgcaggctacttctttcaacgtcttcatcgtttcgctccttttcatttttgtatcatgaaactgcgctgttgcaacagttttataccataattttattcgccatgtcttttccgatcgcaactcttgaatccttgatgttaacgatcatattaccgtcgatctctgatacgactgtaacttctccgcctggaacaaagccaagattctctaaaaatcttctagtttcttcttttccaccgacttttttaatcgtactcggttctcctgtgtttaacatagtaagcggcatcatttcttcctcttttctcctactgtattgataatgattttcatttcttacgttggttagtatattctaacgttcattagatgtcaataacattattgatattttttctcattaattttcatttcatggaaaaaaacggatattacagagacttttttcacagtttatcgtcaaattgcacaataaagtatgaaaatttcaagtcatttgactttcagtctgacatgaaattgcagtttctctatcctatccgttttatgtattataatttttacagttcttctatctgtaattgtaccttccacacggtatgcgcctcatcgcgcaaaaactcttccggcagatccggtccacaggaattacttccaatgcccatcatccgcgcatccagcgacagtaaggaaccagacgccggttccagttcaaaattatgcctttttcctgccagttcttccaccgtgtaatccgaaacgttaaaatccagataattatctgcctccgcaagcagacggtatttttcattttcaagtgagacatatcggcagtgataatggcttccattctcctgtggtctgatataattttcatgcaggtcttctacctctgcctgaaacatatcgacataacagtgttcccttttatcaatatagctttcatccggtccatagccgtaataagtaacatgacgcatagagcgctcaaccggcagcatgatcccaagccgtggcagcggcggcatcgccatatctttgtgcgcatcaagcgttactatgaccctgccccagcggttcacacaccagtcggcatgaaggtgcactgccggctgacggtatatggctgcaatccctatatctgccacataatgtgcctccccgtccagacagaatgcatcggaatgatatactttggtcattgccgcatcgtagcctgcctctttccacttctccttgatctggatgtcattgtctgtgggtgcacggtaaatctgatatcccgcatgtccccagagaatagattttccatctttgaaaatgccggtcggcgctccggtcttcttcccaaaggcaacacgaagtgtaccgcataatacgatccattcctccggctcctccacaagtacgacctcatgttccgctctgttttccctctgcaaaaccgatactttccgctcctgcatgcaaaactgtgcaaatccaaacgtactgctgcacgctgcatattccaccgcttttttccggataaacgtcagttttacatacacatccatgttttccggcagctttggcaccgggatcgtcaaggctgctttctcatgcggcagcagatgtggcaactcttttgttccatctgcaagaatgactgtttcgtcctgtgcacttccccccgctttgatctcataacacagctctgcctcgccggatgcctcaagaaaatcaaacctgttttccaccaggaacataccattggctgcatcgatctctgtgacaaaaaccggacagatcgcatttttccattcccgaagtcccgtgtgcggtgtacggtctggatagagcagcccatcgacacagaaattgccgtcgtgaaagcgttccccgtgatcgcccccatacagatagcgctcttttccgttctctgccacaccgtcataaatggcatgatcgcaccattcccagacacagccccctaaaaatccctcataacggtacattcggtccatataggcgcggataccgcccggtccatttcccattgcatggacaaactcacacataaaataaggctttttgtttcccggatctgcaaaatactcatcaatccattccacatgcgggtacattctgctgtaaagatcgatcatggatgtgtcgtttacgtgaccttctgcttcataaaccgccccctcgtaatgtgtcaggcgtgtcgggtcatatgccttgacccaacgtcctgctttctcaaacgaatttccgtaaccggactcgttcccaagcgaccagatcaggatacagggtgcatttttatcccgctttacacagcgctccacgcggtctattactgccttatcaaacatcggatccattgccagcgtacaaaaagtcttttttgaagagcccccataaaaagaagttactccgtgcatctcaatatccgcctctgcgatcacataaaaaccgtatctgtcacagtactccggaaaccacggtgcattgggataatggctggtgcggatcgcattaatattatgcgctttcatcaatttgaggtcttcctccaactgttccctgcttatggtatagcctgtctttgcattgctgtcatggcggttcacaccgcgtatcttgatcggtctcccatttagtttcactacggatgactcaatgtggatttcccgtatgcccacattctgatgcaggatttcgttttccgtccgaatctcaagcgtatacagatacggcgtctccgcgctccataacctgggatgttttaccggaaacacaagctttgcctcacttccattcgacaccagtgttgtctgcccctctgcttccacgctgccggaagcatctcttagtatggcacgcacgaaaagctcccgcctgctgccgcccgtcgagcgggaaagggaaagacagacctccgcgctctgcggtgttacctgatcttccccaaacgtgatcccggtcgtcactgtgtaatcacgcacaaagtcacatgggcgttcgatcagccagacatcccggaaaataccggacatccggaacttatcctgatcttccagatatgtaccgtcacaccattttaacacgagaacatccagacggtttgtgccgtcggccagcagctctgtcacttcaaattcactcggcgaatgggaaacctgactgtaacctgcaaatgttccgtttacccacacataaaagcaggaatccacaccctcaaaataaagataactgcgcgactgtgtctgtgactctctcaaaaattctgtttcgtacagcccgcacggattttcatccgggacatagggcggatcgaacgggatcggaaaccgcacattgatatactggtggctgtcatatccatggttctgccaacaggatggaaccggtatactgtcccatcccccctcatttatatgccggcagacatccgttatgtccgcgccctttccctcaccggcaatgcctgcaaacacttctgccgcactggaaaaataatgaaatttccagtttccggaaagacagtttctgcgactctctccgttttcatcctgtggctcgcagcagcatctcgtctcctccgtccccacatgtaaaatctccgggtcttcaaaatatttttccagtctcatagaaattttcctttctgcatcacgcattactccggcaggacaggaatggcaaatgacacaagctcgaatggatgataaacgatcacatctgtcctctctccctcgctgtcctccagcagatttaccggctgtaccgcaaatggcagcaccagttttcctcttgtaccatcctgttcactcagacggatgatgatatttttttcgtcctcactcatctttaccgcctgcacataaagtgtttttttctctgctgccttctgtatgaccgcatcgatacgtccgtcgaactgctgcggcaaggcagtctttttaagtggtacattaaattcaaacgccctgcggttgatccctgcatccagatggtttcctgcatgtggaacgatccggtaacaaaaatcatgttttcccatatctgaggtaatatccggacggatcgtcgcgcgcagcagacttaatgtaatatgattttcatcgaccccgacaccatattttccatcgtttaagatcgcaattccgccgtccgactctgccatatcgcaccatttatgcatacacacctcaaatcttgcctgctgccaggaagtattcttatgggtctccctgcgtataaatccggcgctggtatcgcacaccagttctctggacaccagattcatcccaaattccatcttcgcaagtttgtgtttctcatgccagtccaccagatgttccacttcgatctcgttgctgtccgcaaacagccgtatctgcatcttccagctgctcgcctctgtgccaagcaccacctcaaacaatgcacatgcaccatctgccaccaccagatgaagcggttttttcacagtgatctcaagctctttctctttgtagttcggcagaatatcccatgcgtcataaacacccggcagatcctgataaatgtgcagtttgtgaaacgcaccatccgtccattcacggtcaagatccctgtcataaaaactttccatgctcccgtctttcgcaaaacagattttcgcatgcgcggtttctacccggacccgatacggctcatctacatatttgactgtaatccagtccgccggtctttctgccagaagccgtgcctttttctccatctgccctgcatccatggtctcaaacggtgccatctgcgggcacacaaatgcacctttttttcctttccgcagaaccggtccatcctccatctcaacaaaggtaacttccgtccgctcctgccctaacgagttaaaataggtatcccctgttccaatcagggaatccacacattccctcacttttttatagtcctccatcgcatcctcgtagaccggatggatatgacttcccggcaggatatcatggaactgattgaccagaaacttcttatatatatcccgcacctgttctgcaggataagtttctcccgaaaggcagcgcagggacaataacagttctgcctcgcgcagggcaaattccagctcccggttctcacgtttcaggttggatttcgttgtgaatgtccccctgtgcatttccagatataattcaccatcccacacagcaagattttcatttccctttaaattcttttccagaaaacttgtgcccccggtctgctcggtctttggcatgacagacagtttgtcaaaccggtgcatcagttcgatcatctcctccgtagcaccgctgcccccatcgccatatccaaacatggacaacgtctgtccgccgctctccttatcctgatatgcctcccagttctcctggatctggcttggcatattccaggtgataaagtgtgttggaggaacacatgcatagacatctgtgccatcgatcccgcgccatataaaattattgtgcggaaaacggttggtatcgttccatgtggacattttatttgacacaaaatactccactccgctctttttcaagatctgcggcagtatccagctgtttccaaaaacatccggcagccatgcattattgacagtcttaccgaaccggctgcggaaatacatctgtccatacagacactggcggatcagactttccgccgacgggatattgcagtccggctcaatatacatcgccccgaccggttcgaaattgcccgccgcgatcttttcctttaattcctcaaacagttccgggtaatatttttccagaagttcataggtatacgcctgtgtatgcgtgtaatgaaaatccgggtaacggtccatcagccgcatctgaatcagcacggtgcgcgcattcttctgtaccgcatggatcctgcgccagtaataggcaatatcaagatgcgaatgccctactaatgccacattgccgctgccgcggaaatcaccattttcatagatatgtttctctatgtaagcagatgccgcgcggattccctcattgacatattcatacttctcccgctccatggatggcgactcctgattttgtccgatgcattccctcagtgtctcaaagtcaatctcgtttaaggcattatttaattcctgatttaagaattttctgtaatcttcattaaaataggtactttttgaaacatccagaagaagctgcagatcataaaaaaggctcagtgcatcctgatttactgttgcaagatataatccctgaaattcctgtctgcacccctttaatttcatggaatccggatttcgctcatcatccggctttgaacggttgtacccctccatctcgatcaggagttccccgctgtcaatgtaaggactgagcagtacacggtcacggtttggatccatgccgcccacataaaccccattgacctttacaatgatctccgccgccgtccacatggaaagccacagctcttttccctgcatctcttttggcacggtcacttttgccttaaaaaaaaccgttccgtcgggcgtaaaataaatatcgcccttttttaatctgcgataaccacccggataatactcataagtgttctctcccgtctgtctcgcatccgtaatttcaatatctgtaatctcatatttactttcatataaaaaccgtttcagccatccggctcgcagatccgtatactcctccggtctcatgcttctgcggactacctgtacaaatgccattgcctcttcctccttaaatcgtatcccagaaaaacggttttttccgttctgcaaaaaccgtgacgtctatcccaagatctctttttatttcttcctcgatccagctcatacagcgtggtacgatcgcacacttcgaacattccccctgcagcctgacatgtaaaacatttccatcagttccggtaagatcaataaaaccgccatccccctgcaatttaggggctatcacttcatccacatatttttttaatctctcgtccatttttatccctttactgctcctgctgtcataccattgataaaatatttacttgcaaaaatgtaaatgaccagaatcggaacgatcgcgatggtcgccccggcaaacatgatattccatgctgctgcaccatcgcccgcattctttaacatggtcaccccgactgtcaggggacgctttgaggcatccgtcattgtaaataccagcggaaggatatattcgttccagcctccgcggaaagacaatagcgccacggttgcaaggatcggctttaataccggaagaatgatcttataaaatgtctggaaaaatgtgcatccatcgatttttgccgcctcatcgagttccttcgggaccgaattcatatagccgcggatcaggaaaatataagttgcctgtgcagttcccgccgagatgaacacaacgctccagagagacgtattcatatggatttttaccgccagttcaaacagtggacgcagtgttaccgatcctacatttacaaacataaatgccacaaacagaccatagatcagttccttgcccctgaaatttttacgggcaaatacatatcctgccatgcttgtgacaactaaggtcaggatcatgacacttaaagcaaggaatatactgtttcctgtgtacaccgcaaagtttgcagaattccacgcatcaataaaattctgtacgatccattcagatgggaaaatattgatcccgcctgtaagtaattcctggttcttcttaaacgcccccagcactacataaaaaatagggtacagcgtcaggaacgccacaaacgacatgagcagaactaccaggaaacggatgacctttgtgccggtagaatatactgccgtgtcatttttctttcgcattttcatctgtaaaacctccttataccacctcatcaagttttcttgcaaaatacatataaacagctgtcacgataccaatgatcagcgcagcaaccaagcttaacacggtcgcataaccgatctgtgggtttgtcccgacatcttttccaaaaataagctggtaaatatataaaaacatgacctgtgtacggttgttcggtccgccgtttgtaagtaccatgattgactcataatccttaaatgccccggtgatcgccagcattaaaataatttttaacatcgggcttaacatcggcagtgtgatcttaaaaaatgtctggattccatttgccccgtcgatttttgccgactcatatacgtcctccgaaatgctcgacattcctgagataaaatagatcatataattaccaaaacctgcccagagtgcaacaatcagaaccgaccacatggcggtctttgcatcccctaaccagttaacattctgccctatcacgccgatcgcctttaacacgccgtttaaaacgccattatacgccgcaaagataaatccgaataccatacttgacactgcggtagaaatgatcgtcggcataaaatagaccccccggaaaaaggagctgccccttaatttctggttcagaaaaactgccataatcagtgccagcggaatgataaatataattttgagcaccgcatattcaaatgtgtgcagcacactctgccagaacgtcgtatcggtaagcatacgctcaaaattgtgcattccggtatacgtcgccgtcaatccattgtactcgtaacatacatatcggaaaatccagcaaaacgggtatactgagactaccagtaacataatgaccgccggcaaaagcataagacctgccgcaatgtctcccttgttttttgcgcgtttcagccgttccgcaaaactaaggttcttttttgtttttatcactgtcgtattatttttactcatatgactctccattcctgcgtgtgaaaaatcccacttttcacactgccctccatttttatgctgcctgcatccatatactcctgtctttccatggcgctatccttccatggcaacgggtccatatggatgcaggcatccttttctttcctgcatccatacccggacagcgttttactctgttttataggtaacggttcctgctgacggctgaagcggatcatagttctcaacaatgacacgtttgcatgttccattggaaagtccgctctcaagtgctgcattatagcgtgtattcagatcttcgatggcttcatctgcactgacatatccaagtactacattccataacacggtcttccagtcatctccctctacgctgactgccggtgttgccggataaacatcctcgtaatcctgaagttcaaaatctgcaagtctgccaatattgcttgtatcgacaatgttgctcatataaccggataacggaatgctgtaaccaccctcaaaatatccctttaagaaatcttcacttgaaaaatatttgatgacttcccatgctgcatctttattttcacaggaacttagcatgacatatccgccgttcggtgagcagctcagcgcgcctttgacttcaccggtcagagttggcagttctgctacaccccagtcaaaggagcacgggaactgatcggtaaatacacctgcttcctgggatgcatttccccagagtgcaaatgcaccctgtgcaaataatgcacggctgttatctacgccctgattttcagagcctggaagcacagaaccatctgcataaagttttgccgcttcctccacgatctctttccagctgctaaaatcatatacgccattggcataatcatatccgccaggagttgcgccgctcatctcaccacatccctctaaccatcttgaaaacggactggatgaagtgaatgcgatcccgtaagtggaatcattggtagctgctttggcaagctccacgaaatctgataattttgacggtatctctgttgccccggcagcatttaccagatctttgttccactcaatccttgttccggtacggacaccgtttggaacccagtagatatcatccccaaaggaggtaagtccctcgtatttatggtcatatgcctccgttactttctgaaattcttcgtcccctgcgatatagtctttgatgttatagaagataccggcatccacatatgtctgtaatgtcatgttatcggatgcctggatgctgataatgtccggtgccgttccgccctgataggcaagctggatggaattgtcccagtcatctgtcagtatcgtgtaattgatctgtatatcactgtggctcgcattgaaagaatcgatcatctcattcatatatgcctcgtcatgacggttgtttgtccagaattcaatcgtcgctgcaccgtctttcttcgtatccgatactgctgtctctgttcctgaagcggtcgtatctttcgcactttctgttcccccattgtttccgcagcctgtaacagaaattatcattgccgctgcaagcattgcactaatcactttctttttcatagttttctccttcctttgtttcaggtgttttctgttgtgactatcatgccagatttttcatttccgaacaacggcagtttccacgaacaatgtaacactttctaatatccggtcataaaacttatacaaactgccccttttgctttccatatctccatgttaatatatacaagtattttaataaaacttttttatttttgtatatcattacaattgcagcgcaatatatgattgatgaaagggggattacacaatgaacgaacatatggatgtcacactgatgatcgcagatgatgaatccttcatattgagaggcttaaaagaaattgtttcggattctgacctgcccctgaaactgattggaactgccgggaacggcatggatgcctttgcactccttctctcttccagccctgacattgcgatcatggatatccgcatgccgggcatggacggactggaagtgatccgcagggcaagagatgccggacttaccactcactttctgatcctgagcggttataatgacttttcctatgcacaggaagcgatccgctacaatgtccacggatattttttaaaacctttaaatatcccggaattcaggcaggcactttccgccgaataccaggatgtccttgccacacgcgcaaaatctgcatccgatacaatcagcacggacgaactgagcagcctgatggaatcttcgcgttcctattttcttgcacagcttctgcagggtgagatttcctctgccgacgtgacaaatgcacgcttaaattttctgcatataaaccttggtcccgattcctccgtggctgtcatactgacaccggaaaactctgactccgattttgagaccgactttgcatctatcatcacacataccatccatccggtcttaaaaacatttttttatgaggcgtttctctatcaggaacagcagatcgtatgtatcatcaatctttctgccggaaacgaagatcttctgcttgcaaggatcaaagcctgtctcaccggcctgcagaaaaaaaacggactttcttttttagctgcggtcggaacgattgtaccggaactgtgccagtgctctgcctcttatcaggcagccctctccgcactgtcctaccgcatttacggaacagacacaaaaatctttgattccggcatcatctgccaccagctgccccaggaatcgccccgcagtatcgattccgcaccacttgctgatgccattttaaacggtgataccacgcggatcaaagattactgctcggcattttttgattcgctgttttttgtgcgcatgccaccaccaaactacatattcgggatgtttttatttctgatttccaacgtccagaaagatatcgccatcaaatccagtcatccagtctcttttccggaatttacctttgatgacttaaatatcctcccatctgtatctgaacctaaggactggctcattgatttctttctgaattattccgagctgctgaccgcaagccataacggccatgaccagatcatccgtcaggcaaaggagtatatccggtcacatcttgactgcaatatcaaggcgaaggatgtcgcagcacttgtcgggctgagtgaagcgtactttaccatatattttaagaatcactctggtgtgaacttccgtgactatatcctgtccgagaaaatggagtacgcaaaatccctgatctgtgcacaaaactgttcgatcacggaaatcgcttaccagatcggttaccaggattaccgctccttttcccgcgcatttaaaaataccgtcggcatgtcgccctccgaatatttaaatgccgccagcaaaaatacttccccatgaaaggacttccttatgaaacactctatattttccacaaaattagccatgaagatctggctttatatcatgctgactgttattgcaatcctgcttgtcgtaggcatcgcattagaaatatttttccgccactatgtggcaaacgaaaccctgcggaatgccacacgcgatacaacctacgctgccgacgcattttccgaggaatatgaaaatattttaaaacgttttgtcagccatacggcatctgcggactcctaccagctcatgtgtgatgtgtccgtaccacacaccaaagagtacatgaacttaaatacgagtctgcagtcacagctctccctttatacggacagcagctcactgatccacactgccatgttttccgacaccaaaggccagcttttctactcctataaatcaagactgcgcgatgacaccttttcgccgacggacacatatgcactgtccggcgccccctccatctgcattcatcctgccacacaaagtcctttccgcggccagtcggacatggttgtcattacttaccttcttaccgtcaatccgagtgagcggatggtattgttagctgactcctacgaaaactgtgatgctgttttatattttttcctgaatgcacagcatatccaggattatctggctctttattacaacggaagcacctcggatgtcctgctctaccttaccgacggctccggtactcccatcagcctgtcctctgcggatgacaattatgccatcgccacggacacagccatccagcgcggcatccgctatctgtccggtaccggcaataaattactgcacaccggtgaccgctatatccttctcgtgccgattgcaaacagcgacctgtatctggcaaatatcctgccggaatatgcggtttataccaggatccgcagccttgaccttatgctcttatcgatcgctctggtcatgtttttactgattccgttcctgctgttttttgtgacacgttttgtcacaaaaccgctgaaactcctgatgcagtccgtacaggagattgaaatagggacctatgaaaaaccggctgacggaatccctcctgccgacgagatcggtcagttaagccgctccatcgattccatgtatcagacaatccagcagcagttccggcagatcaaacaggatgaacgggagaatttccagatggaactgcggctgctctccgagcagatcaatccacattttctttacaatacactggaatgtattaatatggaaatctacaatcatcataatgatactgcctcctcgatgctgtcaaacctcggcggctacctccgcatcagcttatcttacggaaacagccagcatctgatcagccaggaggtcgaccaggtcaaagcctacgtcaatatcatgaattaccgttttcggcacagtatccatctgaccaccaatattgacggtgatctgctctccatgaagattttaaaatccattttacagcctctggttgaaaatgccttaaagcacggtttttccatcgacagcagtgtctatttcccgattgctcccatgatcgatatttccatctggagagagcctgacaccttaagtatcgccatcacagacaacggtgccggcatagatatagagcacgccaaagaaatcatgtatggttcagggacagatgcagacggcagacatcatgtcggacttcacaatatttaccatcgtctcaactccttttacggaaaaacagacattacattttcttccattcctttttacgaaaataaaattctgatccgttttccttatcagaatttctgtgaaacacagaatgaatgtgactgacaaaaaaccgctgggcagcgatgtactcgccatccagcggttttattcttaacataaagatatctcaggcaccggcgctatcagctgtaacactgcaaatgtgttcttttcgagggttattacccctctttcttccccggctttctgttccatctcccggattgccacccgatccggcttctccagggaattaaaagcttctttttccattccgcccaacagccatacacgctcaacctgatacggttttccagtctcatcacaaatggtaagctgtttttccttctccgacgcattcacgattttgcaataaactgcgcctgtcgcatcatctcttaccggattataatagacttgctccatctgtgttttcttttcttccccaagagtatctaacaccgatgtccctttcatgcatgaaaacatcttttgcacataataattcggcgttgcgtacgatgtttctccgtcaaaccagatcatatccggcgcccactgtgtaaatccaagtctggcaaataatggtgcataagacgccagtacgaccacatctgcatttctttccactccggttaaaaatgcagcctctgctaatgcccctccaagacagtttttctgttccatcaattcagtgtgccccgggtgcgctgcatattcccctgcaaatactttgacatctcttggatattcatcgtaaaaatctgtatgcgcataaaaccagtccggttccacataataatgttcatctactgcatatacataatttttctgtgtttttactgcgccatgataatatttccatgccttttcataacgttctgatgtgatatccggtcctgcagaaccgatcagccggatctccggatattttgcatgaatgcattcttcaaacagacgatacctctcaaaaaatccggacttctctgtctcccactgttcattgccaattccaagcattgtaagatggaacggttctttatgtcccattgccacgcgcacactgccccatctgccgtcttccgcaccatttgcaaactcgatcagatccagtgcatcctgtaagtactgcccaaacgcctccgtcccgggctgtaccatctcataagactgatactggcatgccagtccgacgtttaacacaggaagcggtttcgcaccaagtgcctcgcagagcaggaaaaattcataatatcccattccaagtgtctggttataatgtgaaaatacactgtgatatccgttttcctcatttaccagatgcactgcccagcgattccagttggatctgcgatgctctaccggttttagtgtctccttgaaccggtaccggttagacaatgtattgccttcaataatacacccacccggaaaccggataaatccaggctgcagatcctttaataattcaaacagatcccgtcggaagataccacacacggcatcttttggcatcatggaaaagaaatcaaactccacaacacctgtctgttctaacatgacagcaaaatctccgccttttacatcttcttttgcagtaagtaaaagatgatattttttccagttatgcggctcctgttttttgccgggcaaaagttctgtttcaccggatgcggcaataatcccgtccttttgtactgatatctgtattctgccctggtaagaaatacttctcgcataaaacgatacctcatactgcgcatcctttttcaatacgatcccgtcataagcctgatttttaaaacccgcctgcgattcctccgccgtaaatcttaaataatgcggattttcttccgcaaccgggcttcccatgacacaccgcattctggcatttttctctttcggataacattcccagccatacagtccgtcaaattcagtataataatctgccttatccccataacagtcgacaaactcaaatgccctgttttccagcatctctgcatacagacctccatccgccgcataattgatatcctcaaaaaacagtcccatcatatccggcatgatatccgcacgttttctctgtgaaattgtaatcttcatatttcctctccttatatacatgatttaatttttttattgtactgcactttcgaagaggtttccatgtcaaacattgcactttttttgttcaaaactgacctttaccgtaaacagatccgccatcgtctccacttcaaatgttccaccacaggcctccgtaaaacttttcgcaatcgaaagtcccagcccgcttccgccatcggtacggctctcatcccctcttgtaaaacgtgcggtaaaatccacatcctgttttaattcactgcgcgatgtattgcgaatatctgcaactgcagcatttttctctgtttttaatgaaatatagatccgtgaaccctccagcgaatatttgagtgcattaccgatcagattctggaatacccggtacatccggtctccgtcggcatataccatgaccgcctccttaggtatatcaattttgaatttgtacgggctcttttgaatctcaccgtccatatctgcaagtgtctgccgcagaagctttccaaaatcaatttcttccatctcaaccgcaagctgtccggatgccgctttgctgacagaaaatacatcctgcaccatatttttcagccgctccgatttttcttccagaatccggatataatcctgaatctccggtgacagattttcctcctgttttagcagctcaatataactgataatggaggtcagtggtgttttaatatcatgggacacattcgccaccagttccactttcatgcgctcgctcttgatacgctcctctatcgcagtttccattccctgtccgatctgctctaatgcttcttccatggcgcggatatcactgtcttctgctttcaccatatctgccggttcataatgtccactactgatctctgtaatcctttttgaaagctgttctaaagatcttgccaaattccggtttcttttctgatagaaatattccataccaagcaggatacaaaatacccctgcaaacccggtcagcagtaacagccagtaaataaaatttgccagtctgtaatttacgatcagcagtaaaacaagcatcacacaagttaccgccagcccaaataccgtaattccaatgatcccatacagagcccttaccagccgttttgcaaatggcagggacatattttttgtctctgcctgtgcgagcagttttccgaaaaatccattttgccagatttttttattatattttgcatcattgatccagaaataacagagccaaaaaatcaccggcagttccaccagacccggaaaatcatactgtatcctcaagacaagaagcagcaccagaatcgtagctaagattttccattcaaaccagattttcgcactcagggcggcgatcacgctatcttcctgtttctttgcatctttgaaaaatctgctggcacacagacaaagaatgcctgcaatgataaaataaattgcctgtatatagcgtttatgctgctgcgtccaccgtgtattaagatcgtaaaaagaattacagatccaggaatttccagcatcatcttctcccatatactgcaccggatcttttgctatgatgatccggatatccgctttctcccaggattctttttccatcaggttttgaaaacccggtacataccagtcctctccctcgcggtaaatgccatctccatagacatcctgctccactccgtctttttcgatcgtcactttttttccatcaaaatgaaatgcataattatacccctccggaagattttttaacaaagcagccgtgttgtttttcccatcagaggatgcgccatctgatgatgtagcatctgttacatcatcaggcatatttgaatacattatttttccgtcatagcagatctcatagaaaaaattatgatccttattaacgtccgcaaaatattcttcttcgcttttttcctgataaccggtactgtcgtcagacgccatataaatatgttccgtgtctgacacctcctcatacgtcgtggaagagttctcatctgtgcccgcagtctctgctgcatccgggttttcataaatgtccgacgtcgcagccgtgcccactacatactccgaaattccgttatttgttccaaacagcctatcaaaaaaatttcctcccggtgacagataatcgtcaatattttcctcgttcacagcactaccgctatatccgctgtccccatgatagtttccagtcgccacatcaagaaacgtataaaatctgttcagcacggtgtttctaaattctttagactcctgatagtccttttctttcagttccgcacagacctcatccacaccgacagaatagctctcatatgcaaatctgccgattcctgccatcagcatactgattccgataaagaacactaaaaatacaatcctatttttccattttttcgattttatagccaattccccacaccacctttaagtattccggctcttttggattgagttcaattttttcacggatgcgcctgatatgtaccatgaccgtattttcgcatgcatacccctgctcattccagacacgctcgtaaatttcctccgccgggaaaacgcgtcccggatatttcatcagaagctccatgatctttgtctccgtcgcagtcagcctgaccggctctttgtccacataaagcactcgctcattcgtatggaactccagcctgccattcgtgatacatccatcatcatctgctttatggatatccccaagacttgtatacctgcggagatgacttttcacacgcgctgctaactcctgtggattgtaaggttttgccacataatcatccgctcccatggacagtcctaagactttgtctgtgtcctcactctttgcactgagcacaatgatcggaatgttttttcgctcgcgtattttcaataccgcagataatccgtcgagttttggcatcatgacatccatgatcaccagatgtaccttctgctccgctatgagctctaatgcctgcatgccatcatacgcttttaatacctgatatccctccttttccaaaagtattgcgattgcccttacgatctcgcggtcgtcatccacgactaatatacattcactcatgctgtatttactcctccttaaagcctatgtctatcttatccggggcttcttacaaaaaaagtgggatatttcttacagatttcttacaatttcccaccgttcttattatttttctccctttttgctattcatttcctgttatatgaagaaaggctatcgcacttgagaggtgaggcagccttagaaagttgattctataaacatatgaacacctttgatttttaaccattgtagtaactcttctattatttttgaagaataaccgtttcttcttttttcaggaatacaatatacatcaactatatatccgtacattggagttttgaagaaacaaaacggaacgtcttccttaattactgcaccccacgcgcaataacactaggaccaattttattatttataagaatttgtcgaagatctacaggctacaaaaagttgctcagctactggttaatacagaaaataacatacaggaaattgcaacggactgtggttttgacgacaacaactatttttccaaactttttaagagacattatcattctgttattatgtcaaattcaaaaacatctgaacatatttatccggtaactcatgaagataccggaaacactcatttggatcatagataattccattttcggcgcatctttttctgaacatatccataagtttctcgttatcagggcttgccagatcatatgcatttccatatgtatagatgtattttttcttaagccctgaaaaatatctgtccaatgcctgataaaaatattccctgtctccatcccttaatgtaactcccatgttgaagcatatgattccttttacgccagcttccatacagtaatcaagaataccattgatgttttcctttgtatcatttataaaaggtaatataggtgtcagccacacgacagttggaatccctgcctttttaaattgcataagtgcttcaaatctctcatgggttgtagaaacattcggctctaaaatcttgcagagtgtttcgtcataagtagtcattgtcatctgtacaacagcttttgctttcgcgttgattgattttaaaatatccatatcccgcaatattctggtagattttgtctgaattgcaacaccatattcatatttgtcaatcagctccaaacatcttctggtcagttttaatttttcttctgcttgaagataatgatcgcacatagcaccggttcctatcatacattttttgcgtttggattttaatgccttttcaagaagctgtggagcatttgcttttacctctatatcctcaaattcatgtgtaaatccatagcagttactcctgctgtcgcaataaatgcagccatgcgtacagcctctgtatatattcattccattattacttgaaagaattccctttgcttctacaaaatgcatatgtactctcccctaattctacaaattggaatctatcgctttgtcccatcctcattgaaattattttttaatgccttttccgttggaaaaatagacccaatcaaaaacaccagttgtattacaatgataataatactcaaaattcccattgtatcgtcacttgctccataaaaaggaatatgtataagcattgtaggtcccaacagaccaataccgactttccaccaaagttttcctgcatggtcatgtgcaaatctccaagtatccatatttatcattgacatcttagttcggtatcccacaactccattgatcttctttggacaatgtttccacatcattctgcccgcaattatcataatcgctggaataatacaatcgcatatcaaaataaaccaccagaaccacatattgccaccttccgcaatgaccattcttcatcatagcttccaagataaactttattctccaaaaattccggctgatgcgctaacagttcaaatcctcgtttcctgcattcttcgatagttccattattatctgcctgaacaccaatttctccaaaatagtaagcattcacattcttcgtatgctcatacatttcatatgctgagcgtggaatctcaccgtaaaaggtttgtctgaccggtaaaacacttttatctttatccggtaccgcttcgtacatcgtcaggaaatcccgtgcagatttcagggcaagtgattttaattcgtcatattccgccatgcttaatggctttttctcctcgtcaaaaagcacatctgagtctgcatcagaaatggtaagtgttgacactttttcttgaatgatctcaggttccggaacatcccaagttaaagctcctttccacttcaagtaagctgaaatttcagacgacatcttcccaatagcttcacacttagatttacctcttgtaaatgcaccaatgaaattggacgcatacagaatactgtcatcgccattatgttcccaaacacacttcactttcataaaagaattttcctcccaaacaccgatttacttaaatgcagtataccacatggtcagcgtcaatgatactattattctcttttataaaataaagaggaaaacgttccaaaaccacttgacatagttttcaaaaccgcttacactgtatactataactatttaacaggattggagaacatcatgtttcagattatcgttgactctgcggcaaatattcccgcagaacttgtaaaaaaatataagatcaaagttctttcttttatcaactttgtaaatggaaaagaagtcacctgttttgatccggaattatccccggaagaggaacgtcagaaaggtcatgaatattacgatgccgtacgccagggtgcagatgtaaagaccggtctgatcagcactgccatatttgaagatgcattccgcagtgccatggaaaataacgaagatgtgctgtatttctcgcttagcaaaaatatcagcggaaatttcaactccgcaagactcgccgcagaagatctgatgcatgatccggtaaacggcagaaaaatccgtctgatcgattcactcaatgcttctttagcacagggaattttagcgatctacgcaagtgaaatgcgtgataaaggtatggagattgatgaagtagcagatatcttagaaacgtaccctgcaaagatgaacggtgtatttaccgtcggtgatttaaaatatctttccagaaccggacgtttgagcggcgcaactgctctcgtcggcaaccttttgagtatcaaaccgatcctgcgcggaaacaaagacggttttattgtccagtacaagaaatgccgcggaagaaaagctgcgttgaacgagctcgtctctctcgtctgtgacaatatcacagaaccggaaaaacagatcatcggaattgcacatgccgatgcctacgaagactcgctctatgtcatggataaaattcagggaaaaatctctgtgcgggaatttatcaatacttcttacgatttctgtaccggaagccatgtgggtccggataccatcgccttgttctttatggcaaaagacagagaattaggggcaggaaaataagcctgccctgaccagcaattattctctatttcatttttcactacagcgccctttccatgcacacaaaccgcatatcataaagactacattcccccactttctcatatcccagatgcatataagcacgcattgccacctcatgcccttcatgcaccaaaatatgaacagatctctttccctgtttcctcaggacattcatggcatacgccatcatcatccttgccagttttttattctgatactctttccggatacagagccttgccagttcggcacccggaagcaacgtctgattccagcattttaagctgtccactgcctcgtctgcatctatggagatcgacgccagcagttccccgtcttcattttccatcacaaaaagcgcatttctggaaagatcggattctattgtgtcaattccaggatagtactcattccagcctgccgctccgccgatcatggaatggtacaattctaagattttcccggtatcttcttttacagcggggcggatatagcgcaaaaatgtataatccgaaattttcaatgaatccgctgcctgtgcaaaatatttttcttcgatatgcggccagcgctttgctcccatatcattttcttcctgcagtttcgctgccagattaacaagttccggtgtcagatctgttccagtcagtaaaatgtgcagattgttattcaaaaaccatggcgccatatcgtaaagtcccgatgtaaaaatatcctgtatcacctgattactatcgtatgggatccgcaaaaattccggtttccattcattttgaccggactctaagatgatggcatgcgcgtatcccggatctccgatcgcaattccacaggaaccggtattcatataggtttttccctgatatctgctgatacccggaaaatgtgtatgggctgcaagcagatagtcagtatcgatctcttctaatacctcttttgtgcggtcactgtcaagctggagcagttctcttgtattgaccggagaaccgtgacagcaggtaaacgccggatatccttccttttcataacgaaacgtgatcggaaggctctcaaaaaaatccagatctctttccgtgagctgcctgtaagtatacaaaagattgccgctggcggaattggcaagccagaatttttcttcttcctccttctcccggatcttacgctgttctatcatatattcttcccggtttccgcgcagcacatgacatgggaactgttccattaattcatagagaagttccatcgtctgccttgcaccggcggtatccgaaataaaatctcccagaagcagaaattcctcacatccggcatttaccatatagtccacacatgcccggaatgcggtctggttgctgtgaatatctgcaattactccaactttcattccaaagtatctttcctttcatttaaccgccattcttacatgtgaaaatttaatttttcacactacggtctgtctaaacattttcttccttgcagacatcgacccagccttttgccccggcgatctgctcaagttccgggatcgtgagtttcactgcactgtggtcatttcccgctgccggatatacgatagtaaattttttcagactttcgtcgagatacacttccacaccatcgttgattccaaacgggcacaccccgcccggcgcatgaccgatcacttcctcaaccgcatcaggcggaatcatcttcgctttcacatgaaatgtatccttgtatttgcggttatcgactttcgccgtgccttccgtcagaatcagcaccgcctgctctccctgtaaaaaggacatcgtctttgcgatcatgcccggctccaccccaagtgcttccgccgccatcgcaacggttgccgtggaatcagccagctcgatcacatgatccaaaaatcctttattctccaaatatgctttcgctttttctaatgacatataaatcctcttttctgtgtaacctgcaggctcagatattgtaatctataaagaacccttttgctgttttcaaatctcatagtccatgcaggatctcaccgctgtgtaaggtctgactttactgtctgcgactgccacatgttttggatgtgtactgtaagtttttaatgcttccgcactctcaaatgtggaatctagcatgacatccacggttgaactcggcagacagtcgatgcgcactttgatttctgtcattcccgggatctgaccggcaagaccttctaatccttccttgatccctgctttgatctgttttttctcctcctctgaaaattcctctttcagtttccataaaataatatgttttaccattttgtttttcctttcttcaggcgttatagacctgataccactattttaatcctcttatttatttttgcaattacggatcatccttcgtacccgcaaaactcaaatttcctctttgccgccgttttttgtccggatcacaaagagaaccacacaaagaagcacgatgcagattggaagtgtcagccatacaatggcgtcaagtcccactgccttaaaaataccgatcagaagatatccaaccatacatacacttcccacaacaagcacatacggaagctgtgtcaccacatggttgacgtgttcacagtgaccgccggcagatgccatgatcgtcgtgtcggagatcggtgaacagtggtctccgcagactgcacccgccagacaggatgcgatggagataaccatcatctgtccttccgggaataccccgatcacgatcgggatcagaatgctgaatgttccccaggatgttccggttgcaaatgccagaaacgcagcaaccaggaaaatgatcatcggaagaaatccctgcatcgcagatgcagaatttgccacaagatctgccacaaaatattttgcaccgagcaggtttgtcatgcctgataacgtccacgccatcgtaaggatcagaatcggcgcgatcatggactggaatccctccgggatacattttgcaaactcttcaaaggacagcacatcacgcatcatataatagataaatgtaaataccagcgtgaccgcaccgccaagcaccagtcccaccgatgcatccgaagctgcaaacgcatcaacaaaggaagcaccctcaaaaaatccaccggtataaaccattgccacaatacagcttgcgatgagaaccgcaaccggaagaatcagatccagcacatgtgctttctcattgatgacctcttcttcatttccctcataaggtcttcccggcgtggtaaacagatctcctgcgattgcattcatctcatgttttttcatcggtccaaagtcaaccctgagtaccgtcacaagtaaaaccatgaccagtgtcagtatcgcatacaggttatacgggatcgtctgtaaaaatacagcaaaaccgttgattccggaatcttccggcaccgaggatgtcactgccgccgcccacgaactgatcggcgcaatgatgcacaccggagctgcagtcgcatcaatgatataggataattttgcacgggatactttgtgccggtctgtgaccgggcgcatcacacttcccaccgtaaggcagttaaaataatcatctacaaagatcagcactccaaggatcataacggaaatctgcgcaccgatccttgtcttaatatgctttgatgcccattttccaaacgcagcagaaccgcccgctttgttaagcatcgagacaagaattccaagcatgactaaaaatacaaggatacccacattccaggcgtccgcaagtttataaaccatacccccgtcttcctgaaagaagatcgtgttgatcatcagttctaaattaaaattggaatataacagtcccccagtgatgatcccggctaaaagggacgtatatacctctttcgtgatgagtgccagaccgatcgcaatgaccggcggcagcagcgcaaataccgtcgcatatacaccgcactggtaattttccggatctgtgatcaccccggatgtatttgccgttacaaacagtaatatcacgatcactgcaagaaaaataagcattccgatctgttttcttttcatatgtttcctccaaacattactgattttttgtctgtcaacaatcaatcagaactttccatatttctatatttccatacgttttatagtgtagcgtttcttctgcaatttttcaaacattttatgcataatcatgcaatattataaaagagtattactgttcactcgtacctcgttccagtaacggattttgccgatgcttcgcattacaaatcggcaaaatctgctgccaccactgtatcatacggcattttcagttcagaaaatgcctgcctgtgaacagtaacagtttgcgtgcttatcatatatcattaatgcactttttccttttaaatatcccataaactgtgatatactatatttcggtgggatacttactaacatatggatatgatctggcattaagtgtccttctattatttccacacctttatatttacacaatattttgatgatatctctgatatcttctttgtactggttgtatatcacttttcttctgtactttggtgtgaatacaatgtgatacttgcacatccatttagtatgtgccatagaatttgtttgatttgccattaaaatcacctttcctttcgttaaatagcagcctgaacaactctattttagcggaaaggtgatttttttgtataacaactttgttgcaccacccgcatagcaggtggtttattgtttcgcacatctccatttctccgttgggagaaactccgatgcactcaacaggctaaagcccataagtagaaaagacgcagatccttaccggatctgcgccttttcatttctaatcatagatctgcccgcgaagcgttgatctattgttttgttttacactgtcttcacacactgtgaaaacttctgttttgcattttctactttgtttgcatcggcatccggtgtcggataaagccctctctgatgcatcatgttaaacacatcttcctggatgcagtgttcctgctctaaacagtgaaggatcgcatccctcacactgtcgtgcacacattcatttgcaaatgcattatagttatttgttgccgccttctcagccgtgagtgcatcggctaagatctctttgtctgtataaatctgctcagtcatgatcttcctccctctcttattccttagcttaactgtgcatacagggagttaaaatgtccctgatgtttctgggaaatctccgtaaattttgcactgatttcctgatcctctgtgtgttctgcaagcatctggaattttttgatcagaagatcctcctcggtcagcagatcatttaacacggataactctttttctgataactggctcatgttccacctccatattttaaatctatcgtcggcatatcgtcttgacattgactcgcctaaacaatagtgtggtcagaacctgtcagattatgcatctcatttaaagtaatccatcaccagttaccagctcatctaaaacagcatacatctgtttaatatctaccggcttacttaagtgggcattcattcctgcatcaaatgatttttttacatcctcctcaaatacattcgcggtcatcgcaacaatcggtaccgttttactgtccgaatgatccgattcacggatacagcgtgtggcagcaagtccatccatgaccggcatccggatatccatcaggatcacatcataatatcccggttcatgcttcaaaaactgttccacgcccgcttttccgttctcagcgatatccaccataaaattcttatgtatcagaatgtttcttgtaatttcaatattgatttcattatcttcgacaagcaatacccttttcccggaaaaatcatattcctgataagtcgtccgctctgtcctccgtctgtcctcttttgcagtctttaatggaaccgtcacgacaaacgcggagccttttcctttctcactgtacacatcaatcttaccgcccataaaatcaataatatttttggaaatggtaagtcctaatccggttccaccgcttaacgtcgtatttctgtcatcttcctgtgcaaatgcatcaaaaatgtgcggcagaaaattctgttccataccgattccattatcccggatctcgaaacggaagatcgtttcctgttctcctctggtaaaaagctctataataaaaaatacgcttccctccggctgtgtatattttacagcgttttctaaaatcgctgacagcgcctcatttaatttttcacggtcaaacagatattgatccgcaaatgaaccacgtctctgtacagaaaaagaaatcttcttctcctgcgccttatctgaaaactctttctcgatatgtgtgaggaatgcttcaaaatccgtactttcctcatggaatgcaacacggccgctctctaagagcgaaaggtttaaaatatcatccatacaggaacgcagaaactgtgccgacatctcaatcttgtcaaaattttccagaacctttttttcatcgccaagatttgccctgctcagataggaaagtccgataattgaattaaggggcgtacggatttcatggctcatgcgctctaaaaattcactcttggaacgatccgcacgctttgccgccagcattgcatcataaatctctctctggcgattctgttcttcttcataattatccgtaacatctctgcgcacaaaaacaagggtcatttttgtcttgtcataatagtggatattcattgatttccgacggtattccccgccgcacaacaaacggtaattaatgacgaaacgttcttttttctgtaaattttcctgcagacgttccagcctaaactccctctcgcacatttctctgtcttccggatgtacatactttggaattgtcacatcattgaccttctggtaatccccatcaatcggcggcataacatccgcatcctcattggtaacaatggtatgtaccatcccatcttccagatctacatatgaaataaaatcaatttcttcttttataacgctctccaaaattgcccgctgtttttccatagtatgttccttttccgatccattttcactgtgctgctctgattttatgaaacctgttttttattataacagttttatttcctgttttaaatagaaaaccaaaataaactgtatctaaagtcctatttttgttactgttcgtaatcttccagaaaactgtgaagtcccatacctgtatgatatgcaatcacagtatttaaatttacattttccacacttttaaagatatttgccgcaattccgggatttatgttttcaaattcctccagcagacgttttacttcttcctgctggtctgaaaagtcctctttcgttcctgttaccattccaaactccatattccattctttcagatcctgcttatgcaccagataaaacgggcggataacctctatgccgccaaagtcacgctccttttcttttggcatcagagtactgatttctcccctatacagcacgcccgtaagtatcatttctatcacatcctcatagcagtctgccaccgctaacttattacagccggagttttttacgtcatccacagaatggagtttttgcaccggaataccagtctcttctgcaatccggataaatttcccgttattctcctcttcgaatgaaaaaaaatccacctcgaaatcaatctttctgtggcgttttatctcctgaaaacattttgcaaggatcagtccattcccgccctgtgcaatacagactgcaacatgatcgccgtcttccactaaccggtaggtgttgattgctcttgcaaaacgtgaaaatattgtcttatgatattttttgcgaagactaaactccgcttcttcttttcttgtatctcccatggaaactccattcttgttttttgctgaaaattcactctataataaattgtacacgttctaaacacactgtcatcaggaacaataaacaatcgaatgcgcatttcccagacattccggtgccaagaatcagtataatttctccgcagagggaagtcaatttctaatatcaaaaaaagaacttcccggtctgaaaaattttcatgaccgttccgttctttttccgttgtgctaatagcaaaaataatgcccaccaattttgacctccacatgttccgtcagcggaaatgtggaaaaatacattgtatcatctcttaatattctggtttttccgtccagcacctgctggatggagtcatattccttctgtgtcggttttgccctgtccctgtttttaaaagaacagaactgtaccggatttttctggcttaaaacctcataaagtgtatccggatacacatcacttctcatacggttaaacacaacctccacaaccgcctgctgtcctttcaccggttctccctgtgattctaaccagacgatccttgcaagcagctctgtttcatccggcgataaagtgatatgccagcggttttccggtgaggccggtgccgcctgagtctcctgcacgatttgtgcatcctgctctgccggagcttcctgcactgtttgtgcagtctgctctgccagagtttcctgcaccgcctgtgcagcctcctccatctttgtttcttttgtggttcttattttttcctgcatcagatcatcatcatatgcagatgttactatcatactttcttttttttcgattcctgttttttcatctgattctggcgtaaatgaatgtgcaaaacgtattgatcctgctgcaagtccctccattgccggaacttctttgatctttacgtcttctttcatgttggatgctgcagtcagactgacgataaaactaaacagcactgccgcgcccaatattctctttctcattttgctcctttcctcaagaatgatacatatatgtcaacatgacgaatgccgtcatttgatacaggcacatatcatacttaggttatatccaaaagtcaaattttttatacatgttttcccgaaaaaaaatttgcttatttttactcaattttttgatatgtgtcctgttttttatcagccattcatccatccgaaattatgttcgaataaggtagaactgaccaggtaaacaaaaaaacacccgttttttcggatgttttttgaaataattgccaaatttattactacgtttttcggatgttttttataaaaaacaatctttttatcttcgataagcacattctttattgctgcaggatgcacagattccggtacttttgtcaccacatttttctgtttcagcagcattccattttactcctgcaccggaactttccccggatttttcccagaaattccgcttagattccactttcagacttccaccggaaagttccgctaaaaacatcacgctttttttgggttccatgcagtatgcctgattgcaggtaatccgattctgtcccatctctgctaaaagctgtgccattttttcaaaaggaagcccctcctccgagccaaaaaaatgataagattcaaggcgctgtttcaaatgtgcctctgcccacctctgaaacatgtcatatcctttccgcaaaagctcccagcagatcgtctcaactgcatatgcttctcttaaacgctctgtgctgctataacggttctcgagctcatctaccctgctccccagcgtaaatatcccgattgcataattttcttctctgcacagattcaggatctgttcacactgacgcctcgtcatgcagtaaaatccttcctccccggcaaggcattcgcgcagttcccctgcaacttcctttagcatttccatatctttttgctcataatggtaatgctttaaaatttccacaaggaaatcgtatgtcagttcattttttaaattagtatgaataaatttctcttctgtcacttatttttccgtctctgctttcttttttaaaaactgcatgataatatcataattttccgcttcgtggggaaatgtgcagtgcatgcaggatttgatgactctgcccttactgttaatatattccggattgcccggacagtgttctctctcatacagcggacaaaaacagaacaggcagttcatctcatcattttccacctcatgacacggataatatttacatgccctgttttcataataacgataggaattttccaaggtcaatgctcctttacgatcacaatggtaagataaccggaggtatcatctaacttttccacctctgtggttattttttcattcatcataccacagttttctaccgaatacacttccagtctgctatctttttgctgtttttgcagcatctgctttaattcccctaatttcttcccggacttcatataaattctggttccggaaaattctgctgtttttcctatctcataggatgccggtatcacatggatctcttctttattgtccgctaacgatattccaagtgtccccgccgccgcacaaaaagacgggactccgtttacgatatgtgcctcatagccgccttttaccacacgtttatggatatactggtaagtggagtaaaccgtcggatctccgatcgtcaaaaaagccacctgtctgccgttatctaacaatttttttatctcaagacagatctgctcatgcgccgcggtaagtctgctttcatcctttgtcatcggaaagggcatacatatcaattctttttctgcaattttcccacatgcctctttcatgattccgtaggcgatgcagtcctctttgctttttgccgggagtatcacggtatcgcactctccaacgatccgtaccgcttttaatgtgaccagctccgggtcaccaggtccgacgccgattccgtagagtatccctgttttttctgtatttttcacggttgtattcccctgtttttacttaaattctgttcctgtgttttcacttcatattttttgtatttcacaacgatttatttatcctgctgcattaaaatgcttccttagctatttacttctgacctgtccgcataattttttgctttttttacaaaattttccgcaaattgcggcgcagatggataataaagatgcggaaatcccacaaagcatgtatttttatcaaaaacacagtcatattttttcccacttaccggttttaatgccacacagtcatcaccgtttgcggtgctgtcgaaataatgaaattcatgcccttttatgctgccattttccggcagaaagtttgattctttttccgtaagttcgatgtacccgaaacgaaccagtttccctgtgtaaaagcagtctcccggcacaacgcctgccatctcataaacatgatgctctgtatcttccatcgtctgatgcagatacataaatccgccacactcagcaacgatcggcatcgcgagttccgccttttccctgatatccgcaagcatcgtcttattttcagataattctttcgcatagagttcagggtaccctcccggaagcaatagaccgtccgcttcttttggcacacttccatcatgaagcggtgaaaaaaatacaatctctgcgccggctttttcaagtgcctttaagttgtcctcataataaaaacagaacgcttcatcgcgtgccacggcaatcacgggtctttttccgcttttttgcaaatgtactttctgcttaccgtaactgtctttttctaatgtgctgccttccggcagttctgatgccccctccgcgattgcgaaaagcctgtctatatcgacggtcttttctaacatatccgccgtttttgccagcagttccgccatcttttctacttcttccgggcgtttaagtcccaaatgtctgctctctaaaagaatctccttctggtttggaaaatatccaagaacttctactggaaaactcttctcgatctccggccgtatcgtctcaaaaaatgcgccggaggtgcggtttaaaataattccacggatcagatgaatcgtatcataggaaagaaaaccggcgatcagcggaagaatgctcctccccattccgtgcgcatcgatgactaaaatgaccggcgtgtctgtcaccgtcgcaagatcataggcagatccttctttccggatcccgcctaacccgtcatacagtcccattacgccttccatcacagagatatctgcatttactgcagactccataaacagttctgccgtcattttctccccggtaaaaaacgtatccagatttttcgatggtattccaagtaccgtgcggtgaaacatcggatcgatataatccggtccacacttaaatgcctgtacttttttcccctgtctttttaatatttcaagcagtgcacaggtgatcgtagtctttccgcttccacttcctgtcgcgccaatcagtattcttggtgtcctcatgactccgtccctcctgcaaaataaaacgacaggataaacaccggattttccgcctgcatcagatgataacgtcccgcctttttcgcacggctgactgacatctggatgatttcttcctgttccaccggaaactcatttaacatagaagaaacagccccaaccgtctctaacgtaattgccgtcactaccacacgcatacgcggatttttccggtataaatccgttaatatctcctttaaactgccattgcttccaccgataaatgcatgagttggaaccggaagccctgtaagtgccccgggtgcctccccacagatcacttttacattggcaagtccatactttgtgcagttcttttcgatcagtgcgacagcctcctgttttcgctcaatggcatagacggtaagattgtctgtcagccttgccatctcgaccgcgattgagcctgtcccgcttccgatatcataaaccaccgcgtcgggtgtcaggtgcattttacagattgccgcctcccggacttcctcctttgtcatcggcaccttatcccggcaaaatgcgtcatccggcagaccatgcgtcaggaattttggatcagaattctttttttctcccgaaatcccctgattctggatcagacaggtataaagtccctcgtcggtaagctgcatacattcttccggggacaatgtttttatctgttccgccggataggacagcgcatatccgaccgtcacagtcgtctcttttaatccacattcgatcagccgcttcccgatttcgcggacgtccgaaacaccggatgtaataacaaacactttttctctcatccctgccgtttttatcaaacgctccatctggtctgtcccatgcaggctgacgattttagcatcctgccagctgttaccactgcgcgcagccagataagaaaccgaggaaatcccaggacagacggacacctccgtgttctccctgccctgcaatgcctgcaccattttttctgcaccgctgtagaatccggtatcgccggaaaataaaatgactgcatggaaaatggctttcccacttttttcacctgcatcatcaaggcatggaagaatgtcttttgccagataatacggcagtcgttccgcagctacattccattgcgccggcaccgcatccagcagtctttttgccccgaataacagatctgcgccttttatacgctccgccgcttcctctgtgatcagttttgtatttcccatgccgatcccgacaagagatacctgcatctgttttcttcgaatgtgtttaccggtcaaacgttctatttcctgaagaatttcctctaggttttccttttgctccccgttctccgcctccgggttttcgatcacaaataccgatacccctgcctttttcgcggcactgatcttctctgaaaatccaccggacgcaccgctctcttttgtgaccatataacggatctgatactgatggagaagtgcaaggttcatttcctcggaaaacgggccctgcatggcaatgatctgtctccctaaaatgccgtttttatgacagatctctatgctctctgtccctggcaggacacggacaaacagccgctccctcaatgcctcattttcgcagtaacagtgcagttccttacttcccgttgtaagaagaatattgccactggtctgctctaacgcacggacacattcctgctgtgactttacataaattacatcgctgtcatctccggccgactgcagtgtccgccgcagacgataatacggaagtcctgcctgtgcggacgcctgcctgatattagaagaaaccacgaccgcatagggatgcgttgcatcaacgattgcagcatagtctcccttttgcatgaattctttcatttcttcttccgtaagtcttccggtgtaaatattccggtactgcccctcggtcatgacctcatgcccatattccgtggcgacacagacatccgcgcagatcccggatgcatctaagatatccgctaactgtctgccctctgtggtgccggaaaaaatcaatatccgtttcatatatgatatcctcttttagtgacgagatgtccgtctatgatctttgtctctgaattaccgataaacacggtcgtaaacatgttgacctgacggtcccgcaattcttttaacgtgcaaagttccatttttgactcatctcttccgatattttccacatatccgcacgggcgtgtctcctcaactgtctctaacagaatatcacaggcacgcatcagatagtccgcacgttttctgctggacgggttgtagatcgcaatcgcaaaatccccatccgccgccgctcttaaacgtttttctattttttcccacggcgtcagtaagtcacttaagctgattacgcagaaatcatggtttaatggtgctccaaggcacgctgctccgctaagtgcagcggtgacgcccggcacgacactaagttcacagtccgggtaactttccccgatctcatacatcaaagatgccattccatagacccccgcatccccactgcagatcagggatacttttttcccttccctcgccttctcaaaacagaggatgcagcgctcccgctcctgcttcatcggtgtagaaagctgctctttttccgcaaatgcttcgcctaacagttttaaataaacctgatagccgatgatcgtatcgcatgccagcagtgtatcatacgcctgcatcgtcatcattgcttcttctcccggtcccattcccacaatatatattttatgtttcatcaaatcttacactccattcccgctcagctatcgcaagcgtcattccgtcttttgccttctttttgagcagtaacctgccctgtactaacatttttttctgattttccctgctgtcacaattttgctgcatatacgatttttcttttccctcactgccacatccaggctgctttattttctctttatcttctttcctgcatgctgcaagcgctgcgcgttcacacacattgtccacgccgactgtctgtgacacaaatgccgaaccgctgaaggttcccggcacttcttttaagacttctttcggatacgtcagaaagtccagcccatatttttttacaaattctaaaaatcccggttcttcttttttcagatcgatcgtggcaaacgctgtaactgcctgtatggatatctgttcctgttctaatgtctctaagacaaactgcccgatctcctcacaggattttccctttttacagcccatgccaaggatgatggtgcgggggatcagccagagcggatctgtatgcgttttaacatccacctgttcatctatgacctgactctttggaatattttttaccggataccttgcagaaatcacaacatccggcatagatatatggtcctgttcttttttcaccgaccacttttgtggcggattttcttcacatgttgttatgtcagatatcagtatcgattttggtatctctccttccacccgcccgcctgtcattatcataatcttctttccatcgagaattttcgacgaaattcctgcaatttcctctttattctgtatgaaaagtccattttctttcgcaaaaacatccacggcaaacgcatgattgacatcggttgccgttgttatgacaggcactgcaccgatccgttttgcaagcagtcctgcaagttcatttgctccgccataatgtccggacaaaaccgggataacaaactgtcccgcctcgtccaccaccagaaccgggatgtctgtcagtttatcacgcagagaaggtgccatggcgcgcaccgcgattccgcatgcgccgatccagatgactgctgtctttttcccatttctgttttgttcgaaacgcgcgcgcatccagtcgtagatgctttctttgacataaaccggatttttgccattggcgcgattgtgttcccggatccactcagtctgtatctctgcatctgatatttcctgatatctgccatactttgtatacagacacacttcgtaccctttcccacacgaatacagacattcccgtatctttgccgagagttctatcccgcgcctggtaaaactcatgatatcgatctgcatgtgttactccttctttttacggaattccgtttcaaaatccggcgcatacagttttgagcgcgcgcagcgtttatttgcaaaaacatttcccaccagaaccagtgctgttttcgtaatattatgtttctttgcaactaacggcaatgtttccactgtacacaggtatgcttcttcttccggccagctcgccttatacactaacgctgccggggtgtctttcgtatacccacctgccacaagacgtctggaaagttcctctaacataccggtacttaagtagatcgccatggatgcctgatgtgctgcaaaactctcgatactctctttttccggcaccgatgtttttcctgccatacgggtaataataaggctctgtgagacctccggcagtgtatattcgatctgcagagatgcagctgcaccaaagcaggcggaaactcccggacagctctcataagaaattccaagttcatcgagacagtccatctgctccctgactgcgccgtaaagacttggctccccggtatgcaggcgcactaccatcttgctctccgactctgcctttctcatcacttcgatcacttcctctaacgtcatcgtggcactattatatatctcacatgcctctttggtataggaaagcagctccggatttaccagtgatcctgcatagatcaccacatccgccttttctaacagtttcattccacgcaccgtgatcagatccgccgccccacagccggcacctgcaaaataaatcatcttttctcctccttcagtctcgcaagcagctctgccgcccctgcactctctccaagtcctccgtgctcgttggaatacaaaatacacgcgaccgcaattttccctgcggctcttttattcaggtaaaacattatcttttgcatgatcagttccatcgtcttttcgcacaatccggcttttttcaacacattaaccgcctcttccgttgtcacgcaggaaaggatctgacgtgccgtatctgcatcggcacccgctgacagagcagatgacgtgatcagttccatccggcagtctccttcctgcgagtgtgtgttcatgatgccgccggcgacttttatcagcttgccgatatgaccggtcagaagcatggcttcaaatccattttccaccgccatatcgatcgtatctccgataaaattactgcattttacactcttatcgagatcataaccataagtccgtttcatataatccagtccgtaatttcccggtgagactgccacaatggaataccccatggcacgcttctgatttaactctacccggattgtttcaagcagtgccctgctgctcatcggctccacaataccgctcgtcccaaggatggagattccgcctgtgatgccaagtctcggattaaacgtctgtgccgcaagcgtctccccctccggcacggaaatttccaccagaagatctgccgtttcatccgtgagcgcacagacttcccgcacctctttttcgatcatctcacgcggcacatgattgatggctgcatttccgaccggctggtctaatcccggttttgtaacacgtccgacaccatatcccccgtcgattacgattctctgtaaatgcgcggactgccctttttgctgcatgctgccatccatcgtactcttttgccgatgcacggacggttctttttgctgtatgccgccgtcaatccttgaaacctctgccacgatatgtgcgcccgtcgtaatgtcaggatcatctccgccatctttgatcacggcacagctcactgcagtttcacttcgccggatatccgtgatttcagcatgataccgaatcccttttggcgtctcgatctctatctcattttttatttttccggtgatcagcatatatgccgccgcttttgccgccgctgccgcacagcttccggtcgtaaatccgtaacgcataggtatctccatttccatttgtaaatatcaatccacctttttcgctgcatcctcccgccgcacttcatacaaaagtgcattacagatcgcagcagccacattgctgcctccttttcttccccggttcacgatacatggcacatctgtgtgcaggatcatttcctttgccacctccacattgacgaatccgaccggaactccgatgataaatgcaggacggtaaattccatcacaaatcagctcatacaaacggatcagtgccgttggtgcgttgccgatggcaaatatgaccggcttgtccagttttgctgcatgttccatggaaatgaccgcccttgtcaccttgcgttcttttgcctctcctgcaacctcctcgtccgccataaaacaacgcgccattccaccatgtgcctcaagcacttttttgttgacaccggagagcgccatatttgtgtctgtcacgatatccgctcctgtgcggatcaggtgttttgcaatctccactgcattctccgaaaaagtaagtgtatctgcatatccgaaatccgcactcgtgtggatcactctttttgtcaccggctcctgctctttcgggatcacaataccacgttcttccagttcttttgtgataattgcaaaactgcgcccctcgatctctcccggcagtacaaattctactgcgcctgttttgtgtaccagttgggctgttgttccaactttatcggcgcactcctgcctttttgctctatcactttgctctttcgaatcctcttttactctgtcaattcgttcttctgacttctctttcatccggtcaatgcattctactgcctgcgcatttccatggatttcccttagcacctcagcaaatatccggttctgttcttccgattttaccgcaatccggtaataacctctctggagtccccggaaattactacagtcacggatcaaaatgccgcgctgtaaaaaaagttcatccagctttttttcactgtaaaacaacagataatctgcatcggaatcatacacaatgcatcctgccgcctttaattcttcacgcaaaaacagcctttgcgtctgtatacaggtcacagtgcgtgcaacatatccctgctctttgattgcagcgactcctgccctctgggcgaataccgaaagattccactccggcagctgcaatctgatcttttccgccagagtctgttcacagaccagatacccaagccgcacccccggaatcgcatataatttggtaaatgcacgcaccacgaccacattcggaaattcttctaaataacttaaaaaggaatatttctgttcttttccggtcagttccataaaacactcatccagcaccagtgtaatgtcacattgtctgcatttttctgcaattttaaatatcagttccggctcaaccagatttccgaccggattatttggatttgccagaaataccagagaaatgctctcgtctaacgcatcaagaatccgttcggtcaggcagaatttttcctcttttttcatctcataaaaaataacttcacagtccagcgcctttgccgcctcttcatatcctaaaaaggacggcaccgggatcagtattttcgatggttttactgcgtgtaaaacggcatggaacaattctgacgcaccatttccaaacacaagctttttctctgatatccgcagctgttctgcaactgcatttgcaagttcctgtgcatggatatccgggtaatgttccgcctcctccaccgcctgatgaagtgcttcccttaccgagtccggcattccaagcggattggtgttcaccgaaaaatccagtcttatctgattgcggtatatatctcctccgtggtactgcattcctttatttctctctttctgtagtctgttcttttattttcggacattgaaacaaaacgaaaccacgctttgtgtgatttgtcgttccaaaaatatagatatatctttcgtattcagagtataacacaaagtgccatctgtacacaattttttgtgttacagacggcactttgtaatctattcttttaattctcctgatttacaaaactttctaaaagaatgggcgaataaacagaatactataaataagttaaaatatgaagctgatcacacgccagatgaaaaggtaagactttatctattaaagcgaattaatgatcttgaaacagaacttgaaacctttacaatataaaaaggcttcacccttatattaagagcgaaacctttaccaagtttatattttacagttctcttcatttctattttattatgtatttccaacactacagatgttttaaccttgcaccaaatacacatatattttttctttatctttatgtattttaataaataataatggtcttgaccaatttttgtctcccatcgaattatttatttcttcaaccacttcttttgccgtatttttaccacttatttctataaccttactattggctccccccatatattctctttctccatatggcgaatacgaacacattgcattttcaaatggcgtatagcgaaacaaatttactctttttctatctgatatctctcctttataccatttatctgctgtaaaaagtaaaaattctaactggtcgttcggcatagaataaaacgatgaatttttgtctgtattcctggtttcctctgttttcaacaattcaaagacctcatttgtaagcttctcatcataagtaccctttttatcaatgtattttccataactattaattgttatcacagctttcgtgaagccatccttggaaattcctgtaacttccgttgttccgctatcctccacaatataatgtgtgtatgatccatctggtgtagtctttttctgaaccaaatcagttctattccacgtccaatccaaagaaactcctaaaaagttttccgtatttacgagttcatccatatttttcgctgattcatcataatcaaatcccgttccttcttcgcgtgaaatattggttttatacaagctataacttactacattgcaagaatatgtctttcctttataagttgctgttacaatagcttttccaccttttaaattattatatattacagcactatttccttcaggatatatacgcactattttttcatctgacgtattccatataacatcatcacaatctgcattattcaatgttaaatacgttccatcatccccatcaccaaatttccaagtaatagatgtagtgcttaattttggtgtttttgtctcaatgctgtcattattatcaggctttttatcttctgtactctcagtattttgtgcatcatctttatgcggcttctttgcagctgtaacccttatgttacattttaatacagatccgtttacttttgcaatgactgtcgtatttccctgtttctttccagtaatcttaccgttttttactgtaacaacatttctattcgaagacgtccaaaccactttcctgcttgtaccttttactttcaatatatacgattttccactctcgatagtgactttcttcttgctgagctccggtttttccactttaacattacatttcaagatagtaccatttatttttgcctgaataaccgttttacctgttttctttccagtaactttaccattttttacagtcgctacctttttattcaaggaactccattttactttccctttcatgccttttattttaagatttacagtttttccaacattaactataatttcattttggtttaagtatgctttcgcaacagtaattttatatatatatgtatttcctttgtcctttatcgtaattttagcttttccaatcgattttcctatgatttttccattctttattacagcaatctttttgttgctagtcttaaatgttgcctttccgctaaaagtctgctcaatggcatatgtttttcctttccctattgtaatatcctttgttacagtttttgcttctacgcttacatttccgatcatacaaacaaaaaatgtgcatatcactgtcataagaatccatataatgcaacttttctttttctctaatttaatcataatccttttctcctcattataaatataaaatctcctcacggtgagtaacctttctgtagccttcatattcaactacatcaattataacatgctgggtacgaagttttgaataaatatttcataacttttctcacttttggaaattaaatctaaaaagcaaacagccagctacaaactgcttgattcataactgtcctagcgcgttgctttctttcttatttgttttttaatatacatacttgtcatttcttttatcataagccttaactttcctgcaaatcattttttcaattttcttctttcgagttgtatatctatctatattagaatttttcgcccaaaaaataacagccacatataatccatagcaaattacagcccttaatatttcaaaacaatctattcttctaatatttgatgtaaaagatgaaataaatccattatccattccatattgcaaaaaactatttatgattataaacaaatacatattacctaccataaggaacaaaaatgctagaaaaaatttaaaatatgtaaaaattttaagaattatacatggtaattgatccatcctgttatcatcattaggataaatatccaagtaatcatatataaatacttttaataactttttatctgttatcgtattatccgtttggatttgagatgtatttatcaaatgtataacatattttggaacacattcatcggtatggtttatctgatcttttatctcttgtaacgcattttcatttccagcttttaacgcttcaataaatggaatcaatatcttattataatattgtttttcccgtttaaaaccacccttaaaaaaagtattatatattaatgtgcacattgtaataagagacgtaactattgccacaataaaatttatattttcttgcatatcactttccctttctatatttattgattgtccttttttctcgattactgtatatgtctcctccgtggtactgcatttcttcatatctcactttctataatctgttcttttattttcagatattcgaacaaaacaaagcgatactttgtgtgatttgacattctaaaaactcagatacatctttcgtattcagagtataacacaaagtgccgcctgtacacaattttttgtgttacagacggcacctgctaataatttttaagattcgggaggcaaaaggtggttttcaattttttgacccccgaatctttttaataatatcccggatatccatgctttgcccgaaaggcttcctggctggcgtggtaatcttccagtgtcatatggttttcctttaaatactgttcaaacatcagtgaatcgatctcatcggcggtatacaaagtacctcccggataccggcagaatatcttttcaccctgattgatgctgcgcataaaatccataaaatcatccacgtcgatcttatcatctaaaaaatctctccagaaattttcatgcgcctcgaaacgcagattccagtcggacggaagctgaccgatcaatgacatgaccttttcatactgttccctgttctcaaaagaaatagaccactcatagccttctgtctgtcccgctttccggcagaaaataccctcctcggtataccaggtgatatagcggatatcctctttatccggctgatcggcaggatatgtacaggatgtggaatctgccgtgagcagatcaccttccgtctggaaccctttttccatggatactttttccatggatgcttcttccacagatgtttccttctcctttcccagctcttctgccgctcttttttcctgttcttcctccatcagtttccggatcgcatcttctaaggaatcgaatttgctgagaaattcatcccactctttctctgtaaaggactgtgacccgatctgataggaattttccgtttcaccatttttgatttttgtaaagatctcctcagatttttcttttaaaagcctggcatattcttcccgtaaatctgtgacagattgctctgaatctgccgtttctgccgctttcttcatattttcggaccaataactgctgtcaaagcaaccgctgtcctccaatatactcctgtcagaacttctttttccggtatctagttctttcattccggcaagcagattatcagccttctcgcctgcagcctgaaaattaaaacgaaccgattgtccggactttacgtttctcccggaactgccggatacagcaaatgttccataacttcctaccccgttaactgtcatttttctcctttctgcagtccgtctgtcagtcgggactgctccactcccctgaaaggaccgagtggttactttatttatcggctgctttaaccatttcccccagtcctttacggattcttatgcgcgcatgtcaaacgggtgatatgcttttttctctatggcatcctgctgtaatttttcctcggttgacagttccttcgttgataatttctgtcctgataattctttc
